US012012458B2

(12) United States Patent
Trager et al.

(10) Patent No.: US 12,012,458 B2
(45) Date of Patent: Jun. 18, 2024

(54) GENETICALLY MODIFIED NATURAL KILLER CELLS FOR CD70-DIRECTED CANCER IMMUNOTHERAPY

(71) Applicant: Nkarta, Inc., South San Francisco, CA (US)

(72) Inventors: James Barnaby Trager, Albany, CA (US); Alexandra Leida Liana Lazetic, San Jose, CA (US); Ivan Chan, Millbrae, CA (US); Chao Guo, San Francisco, CA (US); Katherine Jamboretz, San Francisco, CA (US)

(73) Assignee: NKARTA, INC., South San Francisco, CA (US)

( * ) Notice: Subject to any disclaimer, the term of this patent is extended or adjusted under 35 U.S.C. 154(b) by 240 days.

(21) Appl. No.: 17/303,952

(22) Filed: Jun. 10, 2021

(65) Prior Publication Data

US 2022/0002424 A1 Jan. 6, 2022

Related U.S. Application Data

(60) Provisional application No. 63/201,490, filed on Apr. 30, 2021, provisional application No. 63/141,411, filed on Jan. 25, 2021, provisional application No. 63/090,041, filed on Oct. 9, 2020, provisional application No. 63/038,645, filed on Jun. 12, 2020.

(51) Int. Cl.

| | |
|---|---|
| ***C07K 16/28*** | (2006.01) |
| ***C07K 14/705*** | (2006.01) |
| ***C07K 14/715*** | (2006.01) |
| ***C07K 14/725*** | (2006.01) |
| ***C12N 15/90*** | (2006.01) |

(52) U.S. Cl.

CPC ...... *C07K 16/2875* (2013.01); *C07K 14/7051* (2013.01); *C07K 14/70578* (2013.01); *C07K 14/7155* (2013.01); *C12N 15/907* (2013.01); *C07K 2317/622* (2013.01); *C07K 2319/02* (2013.01); *C07K 2319/03* (2013.01); *C12N 2310/20* (2017.05); *C12N 2800/80* (2013.01)

(58) Field of Classification Search

CPC ............ C07K 16/2875; C07K 14/7051; C07K 14/70578; C07K 14/7155; C07K 2317/622; C07K 2319/02; C07K 2319/03; C07K 14/5443; C07K 14/70575; C12N 15/907; C12N 2310/20; C12N 2800/80; C12N 2510/00; C12N 5/0646; C12N 9/22; C12N 15/102; C12N 15/113; A61K 35/17; A61P 35/00

See application file for complete search history.

(56) References Cited

U.S. PATENT DOCUMENTS

| | | | |
|---|---|---|---|
| 11,166,985 B2 | 11/2021 | Terrett et al. | |
| 11,254,912 B2 | 2/2022 | Terrett et al. | |
| 11,497,773 B2 | 11/2022 | Dequeant | |
| 11,649,438 B2 | 5/2023 | Terrett et al. | |
| 2002/0147307 A1 | 10/2002 | Hilton et al. | |
| 2003/0022311 A1 | 1/2003 | Dunnington | |
| 2004/0043401 A1 | 3/2004 | Sadelain et al. | |
| 2005/0069542 A1 | 3/2005 | Baker et al. | |
| 2006/0079442 A1 | 4/2006 | Ilan et al. | |
| 2006/0292119 A1 | 12/2006 | Chen et al. | |
| 2008/0248043 A1* | 10/2008 | Babcook ................ | C07K 16/10 435/69.6 |
| 2009/0175846 A1 | 7/2009 | Mi et al. | |
| 2012/0058906 A1 | 3/2012 | Smider et al. | |
| 2012/0192298 A1 | 7/2012 | Weinstein et al. | |
| 2016/0185862 A1 | 6/2016 | Wu et al. | |
| 2017/0051071 A1* | 2/2017 | Rueger ................... | A61P 25/00 |
| 2017/0073638 A1 | 3/2017 | Campana et al. | |
| 2017/0088620 A1* | 3/2017 | Nioi .................. | C07K 16/2851 |
| 2017/0101466 A1* | 4/2017 | Handa .................. | A61K 31/603 |
| 2017/0291949 A1* | 10/2017 | Zhou ................. | C07K 16/2866 |
| 2018/0092338 A1 | 4/2018 | Hering et al. | |
| 2018/0100016 A1 | 4/2018 | Song | |
| 2018/0112007 A1 | 4/2018 | Bamdad et al. | |

(Continued)

FOREIGN PATENT DOCUMENTS

| | | |
|---|---|---|
| WO | WO 2006/112869 | 10/2006 |
| WO | WO 2012/078540 | 6/2012 |

(Continued)

OTHER PUBLICATIONS

Veluchamy JP et al. The Rise of Allogeneic Natural Killer Cells as a Platform for Cancer Immunotherapy: Recent Innovations and Future Developments. Front Immunol. 2017; 8: 631 (Year: 2017).*
Imamura M et al. Autonomous growth and increased cytotoxicity of natural killer cells expressing membrane-bound interleukin-15. Blood (2014) 124 (7): 1081-1088) (Year: 2014).*

(Continued)

*Primary Examiner* — Karen A. Canella
*Assistant Examiner* — John J Skoko, III
(74) *Attorney, Agent, or Firm* — Knobbe, Martens, Olson & Bear, LLP

(57) ABSTRACT

Several embodiments of the methods and compositions disclosed herein relate to immune cells that are engineered to express chimeric antigen receptors (CAR) and/or genetically modified to reduce potential side effects of cellular immunotherapy. Several embodiments relate to genetic modifications to the immune cells, such as Natural Killer (NK) cells, to reduce, substantially, reduce, or eliminate expression of a marker by the immune cells that would otherwise cause them to be self-targeted by the CAR. In several embodiments, the CAR targets CD70, and in some embodiments is used for renal cell carcinoma immunotherapy.

26 Claims, 333 Drawing Sheets

Specification includes a Sequence Listing.

(56) References Cited

U.S. PATENT DOCUMENTS

| | | | | |
|---|---|---|---|---|
| 2018/0201901 | A1* | 7/2018 | Duchateau | A61P 35/00 |
| 2018/0273903 | A1 | 9/2018 | Zhang et al. | |
| 2019/0010514 | A1 | 1/2019 | Poirot et al. | |
| 2019/0062735 | A1 | 2/2019 | Welstead et al. | |
| 2020/0063100 | A1 | 2/2020 | Terrett et al. | |
| 2020/0101142 | A1* | 4/2020 | Suri | C07K 14/7155 |
| 2020/0102379 | A1 | 4/2020 | Wang | |
| 2020/0276237 | A1* | 9/2020 | Shiku | A61P 35/00 |
| 2021/0022187 | A1* | 1/2021 | Xu | H04W 72/044 |
| 2021/0060072 | A1 | 3/2021 | Terrett et al. | |
| 2021/0079347 | A1 | 3/2021 | Terrett et al. | |
| 2021/0130454 | A1* | 5/2021 | Jefferies | A61K 31/4015 |
| 2021/0139935 | A1 | 5/2021 | Carson | |
| 2022/0008473 | A1 | 1/2022 | Terrett et al. | |
| 2022/0033505 | A1 | 2/2022 | Obermajer et al. | |
| 2022/0047714 | A1* | 2/2022 | Mulligan | C07K 16/3007 |
| 2022/0233593 | A1 | 7/2022 | Trager et al. | |
| 2022/0378829 | A1 | 12/2022 | Terrett et al. | |
| 2022/0387488 | A1 | 12/2022 | Terrett et al. | |
| 2022/0387571 | A1 | 12/2022 | Terrett et al. | |
| 2022/0387572 | A1 | 12/2022 | Terrett et al. | |

FOREIGN PATENT DOCUMENTS

| | | |
|---|---|---|
| WO | WO 2018/064602 | 4/2018 |
| WO | WO 2018/081476 | 5/2018 |
| WO | WO 2018/098363 | 5/2018 |
| WO | WO 2018/183385 | 10/2018 |
| WO | WO 2019/006418 | 1/2019 |
| WO | WO 2019/173324 | 9/2019 |
| WO | WO 2020/014271 | 1/2020 |
| WO | WO 2020/247392 | 12/2020 |
| WO | WO 2021/108455 | 6/2021 |
| WO | WO 2021/157601 | 8/2021 |
| WO | WO 2021/252804 | 12/2021 |
| WO | WO 2023/172879 | 9/2023 |

OTHER PUBLICATIONS

Fujiwara M et al. Cbl-b Deficiency Mediates Resistance to Programmed Death-Ligand 1/Programmed Death-1 Regulation. Front. Immunol. 2017 8:42 1-12 (Year: 2017).*

U.S. Appl. No. 18/179,201, filed Mar. 6, 2023, Trager et al.

International Search Report for International Application No. PCT/US2020/035752, mailed Sep. 14, 2020, in 21 pages.

International Search Report for International Application No. PCT/US21/36879, mailed Nov. 10, 2021, in 20 pages.

Rautela et al. "Efficient genome editing of human natural killer cells by CRISPR RNP," bioRxiv, Sep. 6, 2018, pp. 1-24.

Delconte, et al. "CIS is a potent checkpoint in NK cell-mediated tumor immunity" Nature immunology, May 23, 2016, vol. 17, pp. 816-824.

Delconte, et al. "CIS is a potent checkpoint in NK cell-mediated tumor immunity" Nature immunology, May 23, 2016, vol. 17, in 41 pages (draft Manuscript).

Dou et al. "Abstract: Identification of Trim29 as a Key checkpoint inhibitor of natural killer cells functions," Journal of Immunology, May 1, 2018, vol. 200 Iss. 1, pp. 1of 1.

Dou et at. "Identification of the E3 Ligase TRIM29 as a Critical Checkpoint Regulator of NK Cell Functions," The Journal of Immunology, Jul. 3, 2019, vol. 203, Iss. 4, pp. 1-8.

Al Sayed et al. "CD70 reverse signaling enhances NK cell function and immunosurveillance in CD27-expressing B-cell malignancies", blood, Jul. 20, 2017, vol. 130, No. 3, pp. 297-309.

Bottino, et al. "CIS is a negative regulator of IL-15-mediated signals in NK cells", Translational Cancer Research, Sep. 20, 2016, vol. 5, supplemental 4, pp. 875-877.

Fehniger, "CD70 turns on NK cells to attack lymphoma", Blood Jul. 20, 2017, vol. 130, No. 3, pp. 238-239.

Gruber et al. "Cbl-b mediates TGFβ sensitivity by downregulating inhibitory SMAD7 in primary T cells", Journal of Molecular Cell Biology, May 24, 2013, vol. 5, pp. 358-368.

Kararoudi et al. "Generation of Knock-out Primary and Expanded Human NK Cells Using Cas9 Ribonucleoproteins", Journal of Visualized Experiments, May 2018, in 9 pages.

Lu et al. "Cbl-b is upregulated and plays a negative role in activated human NK cells" J Immunol, Feb. 15, 2021, 206(4); 677-685.

Ran et al. "Genome engineering using the CRISPR-Cas9 system", Oct. 24, 2013, vol. 8, No. 11, pp. 2281-2308.

Guo et al., CISH gene-knockout anti-CD70-CAR NK cells demonstrate potent anti-tumor activity against solid tumor cell lines and provide partial Resistance to tumor microenvironment inhibition, NKARTA Therapeutics, www.nkartatx.com, 1 page.

Buren, et al. "A combined strategy of CD70 car co-expression with membrane bound IL-15 and CISH knockout results in enhanced NK cytotoxicity and persistence" NKARTA Therapeutics, www.nkartax.com.

Viel, et al. "TGF-β inhibits the activation and functions of NK cells by repressing the Mtor pathway", www.sciencesignalling.org, Feb. 16, 2016, vol. 9, Issue 415.

UniProtKB accession No. Q65ZC8 "Single-chain Fv" Oct. 11, 2004 retrieved on Oct. 16, 2021, retrieved from the internet: URL: https://www.uniprot.org/uniprot/Q65ZC8.txt.

Agrawal et al., "RNA interference: Biology, Mechanism, and Applications" Microbiology and Molecular Biology, Rev. Dec. 2003; 67(4):657-685.

Bernard, Pierre-Louis, et al., "Targeting CISH enhances natural cytotoxicity receptor signaling and reduces NK cell exhaustion to improve solid tumor immunity", Journal for ImmunoTherapy of Cancer, May 19, 2022, in 13 pages.

Coquet et al., The CD27 and CD70 costimulatory pathway inhibits effector function of T helper 17 cells and attenuates associated autoimmunity. Immunity. Jan. 24, 2013;38(1):53-65. Epub Nov. 15, 2012.

Guedan et al., Time 2EVOLVE: predicting efficacy of engineered T-cells—how far is the bench from the bedside?: Journal for Immunotherapy Cancer. May 16, 2022; in 16 pages.

Guo, Xuan, et al., "CBLB ablation with CRISPR/Cas9 enhances cytotoxicity of human placental stem cell-derived NK cells for cancer immunotherapy", Journal for Immuno Therapy of Cancer, Mar. 19, 2021, in 11 pages.

Hendel, et al., "Chemically modified guide RNAs enhance CRISPR-Cas genome editing in human primary cells", Nat Biotechnol. Sep. 2015, 33(9): 985-989.

Hooper, et al., "Knockout of CBLB Greatly Enhances Anti-Tumor Activity of CAR T Cells", Lymphoma:Pre-clinical-Chemotherapy and Biologic Agents: Immunologic Approaches, Blood, 132 (Supplemental 1): 338, Nov. 29, 2018, in 2 pages, Abstract.

Kenderian et al., Identification of PD 1 and TIM3 as checkpoints that limit chimeric antigen receptor T cell efficacy in leukemia. Blood. Dec. 3, 2015;126(23):852, in 4 pages.

Kumar, et al., "Deletion of Cbl-b inhibits CD8+ T-cell exhaustion and promotes CAR T-cell funtion" Journal for ImmunoTherapy of Cancer, Jan. 18, 2021, in 6 pages.

Lee et al., 323. Efficient Generation of CART Cells by Homology Directed Transgene Integration into the TCR-Alpha Locus. Mol Ther. 2016 Mav;24(Sunnlement I): SI30. 1 page.

Lu, Ting, et al., "Cbl-b is Upregulated and Plays a Negative Role in Activated Human NK Cells", The Journal of Immunology, Feb. 15, 2021, 677-685.

MacLeod et al., "Generation of a Novel Allogeneic Car T Cell Platform Utilizing an Engineered Meganuclease and AA V Donor Template to Achieve Efficient Disruption of T Cell Receptor Expression and Simultaneous Homology-Directed Insertion of a CD19 CAR" Mol Ther. May 2016;24(Supplement 1): SI56. 1 page.

MacLeod et al., "Integration of a CD19 CAR into the TCR Alpha Chain Locus Streamlines Production of Allogeneic Gene-Edited CAR T Cells" Molecular Therapy, vol. 25, No. 4, Apr. 2017, 949-961.

MacLeod et al., "Integration of a CD19 CAR into the TCR Alpha Chain Locus Streamlines Production of Allogeneic Gene-Edited CAR T Cells" Supplemental Information, 11 pages.

Maude et al., "Chimeric antigen receptor T cells for sustained remissions in leukemia," N Engl J Med., 371(16): 1507-1517, Oct. 16, 2014.

(56) References Cited

OTHER PUBLICATIONS

Patel et al., "CAR T cell therapy in solid tumors: A review of current clinical trials" EJHaem. Oct. 7, 2021, 24-31.
Yang et al., "TGF-β upregulates CD70 expression and induces exhaustion of effector memory T cells in B-cell non-Hodgkin's lymphoma" Leukemia. Sep. 2014;28(9): 1872-84. Epub Feb. 26, 2014.
Zhang et al., "CAR-T Cells in the Treatment of Urologic Neoplasms: Present and Future" Frontiers in Oncology, Jul. 4, 2022, in 11 pages.
Zhou et al., "Effects of RNA Interference on CD70 in dendritic cells of patients with immune thrombocvtooenia" Blood. Dec. 2, 2016;128(22): 1373. (Abstract Only) in two pages.
Zah, et al., "T Cells Expressing CD19/CD20 Bispecific Chimeric Antigen Receptors Prevent Antigen Escape by Malignant B Cells", Cancer Immunology Research, Apr. 8, 2016, in 15 pages.
Brudno, Jn et al., "Safety and feasibility of anti-CD19 CAR T cells with fully-human binding domains in patients with B-cell lymphoma" pp. 270-280. Nature Medicine, vol. 26, No. 2, Jan. 2021.
International Search Report and Written Opinion for International Application No. PCT/US23/63795, mailed Oct. 18, 2023, in 59 pages.
Zhu, Huang, et al., "Metabolic Reprograming via Deletion of CISH in Human Ipsc-Derived NK Cells Promotes In Vivo Persistence and Enhances Anti-tumor Activity" Cell Stem Cell, Aug. 6, 2020, 27, pp. 224-237.
Guo, et al. "CBLB, CISH and CD70 multiplexed gene knockout with CRISPR/Cas9 enhances cytotoxicity of CD70-CAR NK cells and provides greater resistance to TGF-β for cancer immunotherapy" AACR Poster, 2022, 1page.
Guo, et al. "ADAM17 knockout NK or CAR NK cells augment Antibody Dependent Cellular Cytotoxicity (ADCC) and antitumor activity", UB Research Poster Template, AACR, 2023, 1 page.
Aman, et al. "CIS Associates with the Interleukin-2 Receptor β Chain and Inhibits Interleukin-2-dependent Signaling" The Journal of Biological Chemistry, vol. 274, No. 42, Issue of Oct. 15, 1999, pp. 30266-30272.
Buren, Luxuan, et al. "Abstract B64: Coexpression of a CD19-0X40-CD32 CAR with membrane-bound IL-15 enhances natural killer cell function" Cancer Immunol Res (2020), 8 (3 Sepplement), Mar. 2, 2020.
Comfort, "Signaling Pathways Activated by Interleukin-2 and Interluekin-4 Receptors Mediate T Lymphocyte Clonal Expansion" Chemical and Materials Engineering Faculty Publications, Oct. 2007, in 97 pages.
Elinav, Eran, et al. "Suppression of hepatocellular carcinoma growth in mice via leptin, is associated with inhibition of tumor cell growth and natural killer cell activation", Journal of Hepatology, 44(2006) 529-536.
Eyquem, et al., "Targeting a CAR to the TRAC locus with CRISPR/ Cas9 enhances tumour rejection" author manuscript, Sep. 2, 2017, 28 pages.
Fraietta, et al. "Determinants of response and resistance to CD19 chimeric antigen receptor (CA) T cell therapy of chronic lymphocytic leukemia" Nat. Med. May 2018, 24(5): 563-571.
Huntington, Nicholas et al., "Interleukin 15-mediated survival of natural killer cells is determined by interactions among Bim, Noxa and Mcl-1" nat Immunol. Aug. 2007; 8(8): 856-863.
Huntington, Nicholas, "The unconventional expression of IL-15 and its role in NK cell homeostasis", Immunology and Cell Biology (2014) 92, 210-213.
Imada, et al. "Stat5b is Essential for natural Killer Cell-mediated proliferation and Cytolytic Activity" The Journal of Experimental Medicine, vol. 188, No. 11, Dec. 7, 1998, 2067-2074.
Jaspers, et al. "Development of CAR T cells designed to improve antitumor efficacy and safety", Pharmacol Ther. Author manuscript, Oct. 2017, 178: 83-91.
Khan, Muhammad, et al. "NK Cell-based Immune Checkpoint Inhibition", frontiers in Immunology, Feb. 13, 2020, vol. 11, Article 167, in 31 pages.
Khor, et al, "CISH and Susceptibility to Infectious Diseases" N Engl J Med. Jun. 3, 2010; 362 (22) 2092-2101.
Kile, et al. "The suppressors of cytokine signalling (SOCS)" CMLS, Cell Mol. Life Sci, 58 (2001) 1627-1635.
Leonard, Warren, "Cytokines and Immunodeficiency Diseases" Immunology, Macmilan Magazines Ltd., Dec. 2001, vol. 1, pp. 200-208.
Li, Yangxi, et al., "Tumor immunotherapy: New aspects of natural killer cells" Chinese Journal of Cancer Research, 2018, 30 (2): 173-196.
Liu, Xiaojuan et al., "CRISPR-Cas9-mediated multiplex gene editing in CAR-T cells", Cell Research (2017), 27:154-157; published online Dec. 2, 2016, 154-157.
Mandal, et al. "Efficient Ablation of Genes in Human Hematopoietic Stem and Effector Cells using CRISPR/Cas9" Cell Stem Cell, vol. 15, p. 643-652, Nov. 6, 2014, including supplement information totaling 27 pages.
Marcais, Antoine, et al. "The metabolic checkpoint kinase mTOR is essential for interleukin-15 signaling during NK cell development and activation", Nat Immunol. Aug. 2014; 15(8): 749-757.
Matsumoto, et al., "Suppression of STAT5 Functions in Liver, Mammary Glands, and T Cells in Cytokine-Inducible SH2-Containing Protein 1 Transgenic Mice", Molecular and Cellular Biology, Sep. 1999, vol. 19, No. 9, p. 6396-6407.
Miah, et al., "CISH is induced during DC development and regulates DC-mediated CTL activation", European Journal of Immunology, 2012, 42: 58-68.
Mirzaei, et al. "Chimeric Antigen Receptors T Cell Therapy in Solid Tumor: Challenges and Clinical Applications" Frontiers in Immunology, Dec. 22, 2017, vol. 8, 1-13.
Mollanoori, et al., "CRISPR/Cas9 and CAR-T cell, collaboration of two revolutionary technologies in cancer immunotherapy, an instruction for successful cancer treatment" Elsevier, Human Immunology, Sep. 23, 2018, 7 pages.
Munitic, et al. "CD70 Deficiency Impairs Effector CD8 T Cell Generation and Viral Clearance but is Dispensable for the Recall Response to Lymphocytic Choriomeningitis Virus", The Journal of Immunology, 2013, vol. 190, p. 1169-1179.
Newick, et al. "Chimeric antigen receptor T-cell therapy for solid tumors", Molecular Therapy, Oncolytics, Official Journal of the American Society of Gene & Cell Therapy, Apr. 13, 2016, 7 pages.
Osborn, et al., "Evaluation of TCR Gene Editing Achieved by TALENs, CRISPR/Cas9, and megaTAL Nucleases", www.moleculartherapy.org, vol. 24, No. 3, 570-581, Mar. 2016.
Palmer, et al. "Cish actively silences TCR signaling in CD8+T cells to maintain tumor tolerance" The Journal of Experimental medicine, vol. 212, No. 12, p. 2095-2113.
Poirot, et al., Multiplex Genome-Edited T-cell Manufacturing Platform for "Off-the_Shelf" Adoptive T-cell Immunotheraples, Cancer Research, Jul. 16, 2015, 3853-3864.
Putz, et al., "Targeting cytokine signaling checkpoint CIS activates NK cells to protect from tumor initiation and metastasis" Oncolmmunology, 2017, vol. 6, No. 2, in 11 pages.
Queval, et al., "Mycobacterium tuberculosis Controls Phagosomal Acidification by Targeting CISH-Mediated Signaling" Cell Reports 20, 3188-3198, Sep. 26, 2017.
Ramsborg, et al., "Global transcriptional analysis delineates the differential inflammatory response interleukin-15 elicits from cultured human T cells" Experimental Hematology, 35 (2007) 454-464.
Ren, et al., "A versatile sytem for rapid multiplex genome-edited CAR T cell generation" Oncotarget, Feb. 9, 2017, vol. 8, No. 10, pp. 17002-17011.
Ren, et al., "Advancing chimeric antigen receptor T cell therapy with CRISPR/Cas9", Protein & Cell, Mar. 30, 2017, 8(9); 634-643.
Ren, et al., "Multiplex Genome Editing to Generate Universal CAR T Cells Resistant to PD1 Inhibition", Clinical Cancer Research, Nov. 4, 2016, 2255-2266.
Rupp, et al., "CRISPR/Cas9-mediated PD-1 disruption enhances anti-tumor efficacy of human chimerica antigen receptor T cells", Scientific Reports, Apr. 7, 2017, 7:737, 10 pages.
Sathe, et al., "Innate immunodeficiency following genetic ablation of MCI1 in natural killer cells" Nature Communications, Aug. 14, 2014, in 10 pages.

(56) References Cited

OTHER PUBLICATIONS

Guo et al., "CISH gene-knockout anti-CD70-CAR NK cells demostrate potent anti-tumor activity against solid tumor cell lines and provide partial resistance to tumor microenvironment inhibition" SITC Poster, Nov. 2021, 1 page.
Staahl, et al. "Efficient genome editing in the mouse brain by local delivery of engineered Cas9 ribonucleoprotein complexes" Nat Biotechnol. May 2017; 35(5): in 16 pages.
Torikai, et al., "A foundation for universal T-cell based immunotherapy: T cells engineered to express a CD19-specific chimeric-antigen-receptor and eliminate expression of endogenour TCR" Gene Therapy, Blood, Jun. 14, 2012, vol. 119, No. 24, 5697-5705.
Huntington, (@Dr_Nick_Bikes) Twiter Feed, May 27, 2021, 1 page.
Izawa, et al. "Inherited CD70 deficiency in humans reveals a critical role for the CD70-CD27 pathway in immunity to Epstein-Barr virus infection" The Journal of Experimental Medicine, 2017, vol. 214, No. 1, 73-89.
Walcheck, et al., "Ink-CD64/16A cells: a promising approach for ADCC?" Expert Opinion on Biological Therapy, 2019, vol. 19, No. 12, 1229-1232.
Yang, et al., "The signaling suppressor CIS controls proallergic T cell development and allergic airway inflammation" nature immunology, vol. 14, No. 7, Jul. 2013, in 11 pages.
Yoshimura, et al., "Negative regulation of cytokine signaling influences inflammation" Current Opinion in Immunology, 2003, 15:704-708.
Yoshimura, et al., "Negative regulation of cytokine signaling and immune responses by SOCS proteins" Arthritis Research & Therapy, Jun. 2005, vol. 7, No. 3 p. 100-110.
Guo, et al., "CRISPR/Cas9-gRNA RNP mediated gene knockout of TGFβR2 and CISH enhances CD19-CAR Nk cell function and provides resistance to TGFβ" AACR Poster, Jun. 2020.

* cited by examiner

F

A
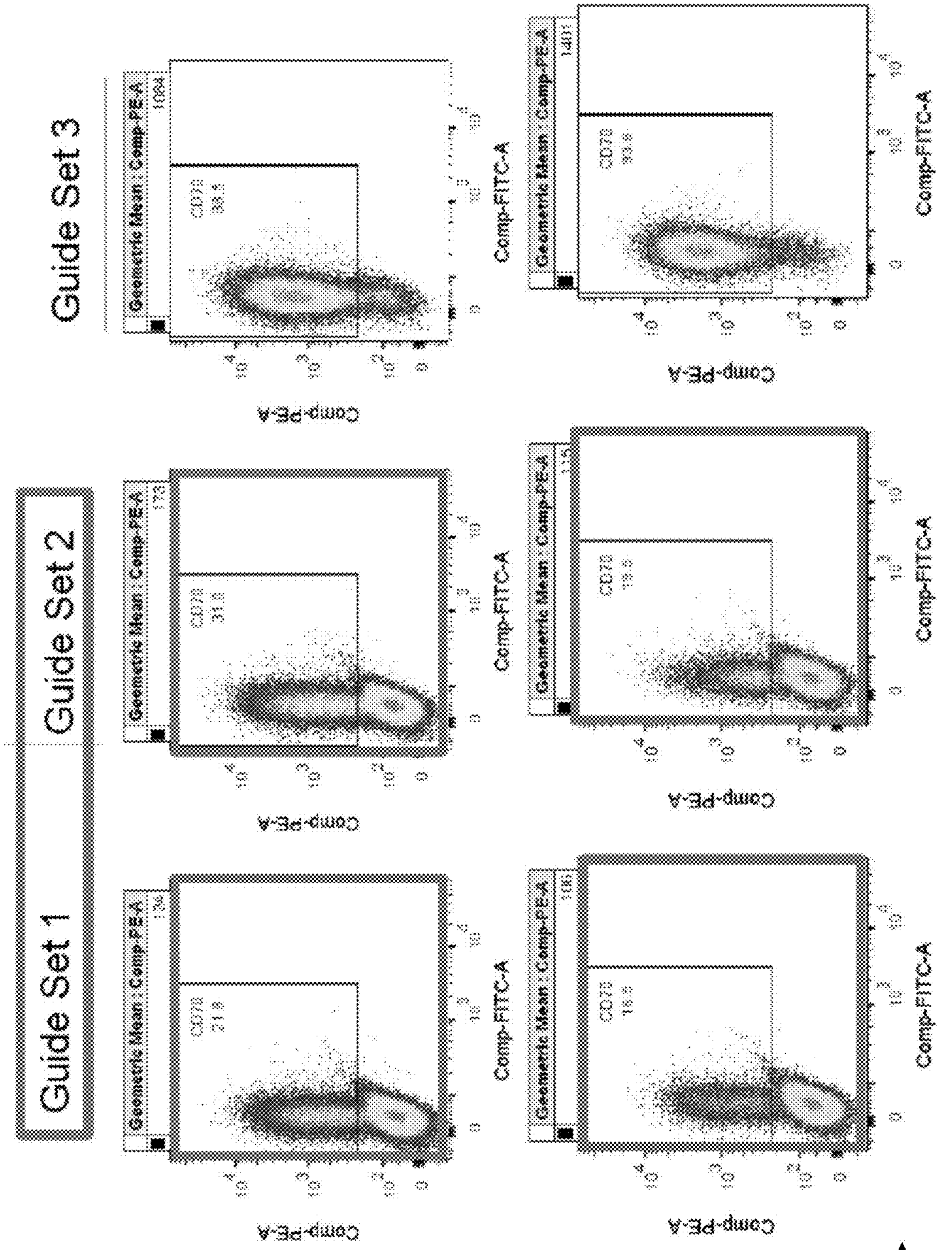
FIG. 17A
B
FIG. 17B
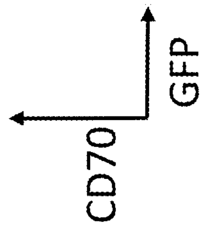

A

B

C

D

A

B

| Donor | Knockout | Viability % | E6 Viable/mL | uL for 1e5 | E6 Total Viable | Fold Growth | CD70% Initial | CD70% D7 Post Expansion | CD70% Final |
|---|---|---|---|---|---|---|---|---|---|
| 975 | 1 | 74.8 | 0.417 | 239.8 | 0.834 | 1.668 | 1.3 | 21.8 | 6.09 |
| 975 | 2 | 77.1 | 0.491 | 203.7 | 0.982 | 1.964 | 1.72 | 31 | 15.4 |
| 975 | 3 | 79.6 | 0.446 | 224.2 | 0.892 | 1.784 | 2.86 | 88.5 | 57.2 |
| 977 | 1 | 78.5 | 0.626 | 159.7 | 1.252 | 2.504 | 1.73 | 16.5 | 5.04 |
| 977 | 2 | 73.3 | 0.502 | 199.2 | 1.004 | 2.008 | 1.19 | 19.5 | 2.91 |
| 977 | 3 | 79.8 | 0.625 | 160.0 | 1.25 | 2.5 | 3.16 | 93.6 | 49 |
| 977 | c | 67.2 | 0.383 | 261.1 | 0.766 | 1.532 | 5.09 | 99.3 | 80.9 |

Figure 25

| | MFI | | | | MFI on higher PE | |
|---|---|---|---|---|---|---|
| | | | CD70 Ab | | CD70 Ab | |
| Cells | (-) | 2nd Ab | 1 ul | 5 ul | 1 ul | 5 ul |
| Jurkat cells | 30 | 35 | 87 | 117 | | |
| gRNA-2 Jurkat | 29 | 32 | 41 | 56 | | |
| CD70 Jurkat | 35 | 38 | 20511 | 21788 | 47196 | 49167 |
| CD70 on gRNA-1 Jurkat | 75 | 37 | 16799 | 17640 | 45339 | 46083 |
| CD70 on gRNA-2 Jurkat | 236 | 36.8 | 21736 | 23500 | 47454 | 46558 |
| 786-O cells | 411 | 146 | 42251 | 46484 | 35508 | 37612 |

C

CD70+CISH gRNA

CD70 CAR
NK71
APC

D

CD70+CISH gRNA

CD70
PE

J

I

C

A

B

C $3x10^5$ NK cells/condition transduced on day7

A

B

A

B

E:T=1:2
NK71 CAR
786-O (CD70 high) target
7d post transduction (D14)
No TGFb added

C

191108 Dnr1353 786-O NR 1:1 NK72 7d post transduction

E:T=1:1
NK72 CAR
786-O (CD70 high) target
7d post transduction (D14)
No TGFb added

D

A

B

D

E:T=1:2
NK72 CAR
ACHN (CD70 low) target
7d post transduction (D14)
No TGFb added

A

B

A

B

B

A
FIG. 41A
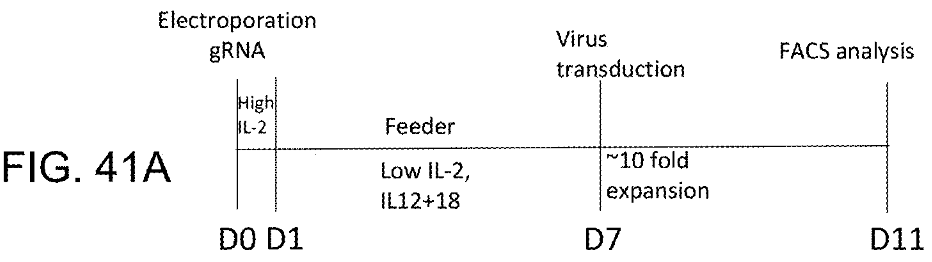
B
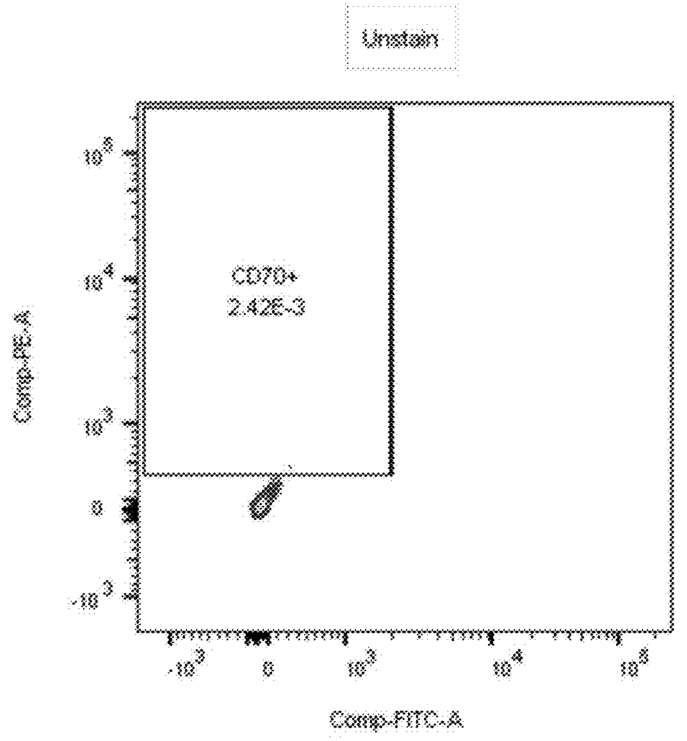
FIG. 41B
C
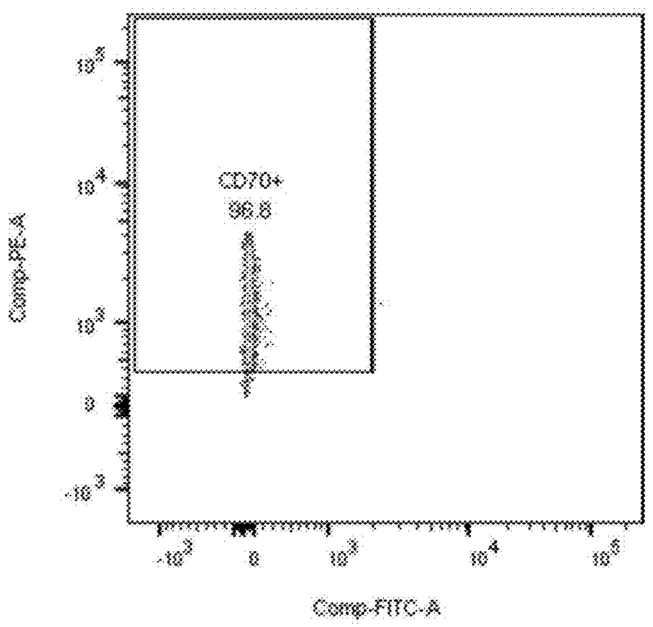
FIG. 41C

CD70 gRNA+NK71

CD70 gRNA+NK72

CD70 gRNA CISH gRNA + NK71

CD70 gRNA CISH gRNA + NK72

Electroporation + NK71

Electroporation + NK72

A

E:T=1:2
NK71 CAR
786-O (CD70 high) target
14d post transduction (D21)
NK cells pre-Tx o/n +/-TGFb and in assay

B

CD70-1 gRNA

CD70-2 gRNA

C

CD70-3 gRNA

D

CD70-1+3 gRNA

E

CD70-1+2 gRNA

F

CD70-2+3 gRNA

G

CD70-1+CISH gRNA

H

CD70-1+A2AR gRNA

EP Only

A

A

A

C

D

E

F

A

E:T=1:1 at 72 hrs
NECA at 1 μM

B

E:T=1:2 at 72 hours

NECA at 0.75 μM

D

E:T=1:2 at 72 hours
NECA at 0.75 μM

F

1:4 E:T; TGFb at 20 ng/mL

G

H

1:4 E:T; NECA at 10 uM

| scFv | VH peptide sequence SEQ ID NO: | VL peptide sequence SEQ ID NO: | VH nucleic acid sequence SEQ ID NO: | VL nucleic acid sequence SEQ ID NO: |
|---|---|---|---|---|
| NK77.1_CD70_DB01_C03 | 890 | 964 | 1038 | 1112 |
| NK77.2_CD70_DB01_D02 | 891 | 965 | 1039 | 1113 |
| NK77.3_CD70_DB01_E06 | 892 | 966 | 1040 | 1114 |
| NK77.4_CD70_DB01_G04 | 893 | 967 | 1041 | 1115 |
| NK77.5_CD70_DB01_G05 | 894 | 968 | 1042 | 1116 |
| NK77.6_CD70_DB01_G07 | 895 | 969 | 1043 | 1117 |
| NK77.7_CD70_DB01_G11 | 896 | 970 | 1044 | 1118 |
| NK77.9_CD70_DB02_A03 | 897 | 971 | 1045 | 1119 |
| NK77.10_CD70_DB02_A04 | 898 | 972 | 1046 | 1120 |
| NK77.11_CD70_DB02_A05 | 899 | 973 | 1047 | 1121 |
| NK77.12_CD70_DB02_A06 | 900 | 974 | 1048 | 1122 |
| NK77.13_CD70_DB02_A07 | 901 | 975 | 1049 | 1123 |
| NK77.14_CD70_DB02_A08 | 902 | 976 | 1050 | 1124 |
| NK77.15_CD70_DB02_A09 | 903 | 977 | 1051 | 1125 |
| NK77.16_CD70_DB02_A11 | 904 | 978 | 1052 | 1126 |
| NK77.17_CD70_DB02_B06 | 905 | 979 | 1053 | 1127 |
| NK77.18_CD70_DB02_B09 | 906 | 980 | 1054 | 1128 |
| NK77.19_CD70_DB02_C03 | 907 | 981 | 1055 | 1129 |
| NK77.20_CD70_DB02_C04 | 908 | 982 | 1056 | 1130 |
| NK77.22_CD70_DB02_C07 | 909 | 983 | 1057 | 1131 |
| NK77.24_CD70_DB02_D02 | 910 | 984 | 1058 | 1132 |
| NK77.25_CD70_DB02_D04 | 911 | 985 | 1059 | 1133 |
| NK77.26_CD70_DB02_D10 | 912 | 986 | 1060 | 1134 |
| NK77.27_CD70_DB02_D11 | 913 | 987 | 1061 | 1135 |
| NK77.28_CD70_DB02_E04 | 914 | 988 | 1062 | 1136 |
| NK77.29_CD70_DB02_F06 | 915 | 989 | 1063 | 1137 |
| NK77.31_CD70_DB02_F08 | 916 | 990 | 1064 | 1138 |
| NK77.32_CD70_DB02_G07 | 917 | 991 | 1065 | 1139 |
| NK77.33_CD70_DB02_H04 | 918 | 992 | 1066 | 1140 |
| NK77.34_CD70_DB02_H05 | 919 | 993 | 1067 | 1141 |
| NK77.35_CD70_DB02_H08 | 920 | 994 | 1068 | 1142 |
| NK77.36_CD70_DB03_A06 | 921 | 995 | 1069 | 1143 |
| NK77.37_CD70_DB03_A07 | 922 | 996 | 1070 | 1144 |
| NK77.38_CD70_DB03_A08 | 923 | 997 | 1071 | 1145 |
| NK77.39_CD70_DB03_A09 | 924 | 998 | 1072 | 1146 |
| NK77.40_CD70_DB03_A11 | 925 | 999 | 1073 | 1147 |
| NK77.41_CD70_DB03_A12 | 926 | 1000 | 1074 | 1148 |

Figure 50A cont.

| scFv | VH peptide sequence SEQ ID NO: | VL peptide sequence SEQ ID NO: | VH nucleic acid sequence SEQ ID NO: | VL nucleic acid sequence SEQ ID NO: |
|---|---|---|---|---|
| NK77.42_CD70_DB03_B01 | 927 | 1001 | 1075 | 1149 |
| NK77.43_CD70_DB03_B04 | 928 | 1002 | 1076 | 1150 |
| NK77.44_CD70_DB03_B06 | 929 | 1003 | 1077 | 1151 |
| NK77.45_CD70_DB03_B09 | 930 | 1004 | 1078 | 1152 |
| NK77.46_CD70_DB03_C05 | 931 | 1005 | 1079 | 1153 |
| NK77.47_CD70_DB03_D11 | 932 | 1006 | 1080 | 1154 |
| NK77.48_CD70_DB03_E01 | 933 | 1007 | 1081 | 1155 |
| NK77.49_CD70_DB03_E03 | 934 | 1008 | 1082 | 1156 |
| NK77.50_CD70_DB03_E09 | 935 | 1009 | 1083 | 1157 |
| NK77.51_CD70_DB03_F02 | 936 | 1010 | 1084 | 1158 |
| NK77.52_CD70_DB03_F05 | 937 | 1011 | 1085 | 1159 |
| NK77.53_CD70_DB03_F06 | 938 | 1012 | 1086 | 1160 |
| NK77.54_CD70_DB03_F09 | 939 | 1013 | 1087 | 1161 |
| NK77.55_CD70_DB03_F12 | 940 | 1014 | 1088 | 1162 |
| NK77.56_CD70_DB03_G06 | 941 | 1015 | 1089 | 1163 |
| NK77.57_CD70_DB03_G11 | 942 | 1016 | 1090 | 1164 |
| NK77.58_CD70_DB03_H08 | 943 | 1017 | 1091 | 1165 |
| NK77.59_CD70_DB03_H10 | 944 | 1018 | 1092 | 1166 |
| NK77.60_CD70_DB04_A05 | 945 | 1019 | 1093 | 1167 |
| NK77.61_CD70_DB04_A07 | 946 | 1020 | 1094 | 1168 |
| NK77.62_CD70_DB04_A10 | 947 | 1021 | 1095 | 1169 |
| NK77.63_CD70_DB04_A11 | 948 | 1022 | 1096 | 1170 |
| NK77.64_CD70_DB04_B03 | 949 | 1023 | 1097 | 1171 |
| NK77.65_CD70_DB04_B05 | 950 | 1024 | 1098 | 1172 |
| NK77.66_CD70_DB04_B07 | 951 | 1025 | 1099 | 1173 |
| NK77.67_CD70_DB04_C01 | 952 | 1026 | 1100 | 1174 |
| NK77.68_CD70_DB04_C04 | 953 | 1027 | 1101 | 1175 |
| NK77.69_CD70_DB04_C06 | 954 | 1028 | 1102 | 1176 |
| NK77.70_CD70_DB04_C07 | 955 | 1029 | 1103 | 1177 |
| NK77.71_CD70_DB04_D02 | 956 | 1030 | 1104 | 1178 |
| NK77.72_CD70_DB04_D05 | 957 | 1031 | 1105 | 1179 |
| NK77.73_CD70_DB04_D07 | 958 | 1032 | 1106 | 1180 |
| NK77.74_CD70_DB04_D08 | 959 | 1033 | 1107 | 1181 |
| NK77.75_CD70_DB04_D10 | 960 | 1034 | 1108 | 1182 |
| NK77.85_CD70_DB03_B02 | 961 | 1035 | 1109 | 1183 |
| NK77.86_CD70_DB04_A06 | 962 | 1036 | 1110 | 1184 |
| NK77.87_CD70_DB04_A09 | 963 | 1037 | 1111 | 1185 |

| scFv | CDR-H1 SEQ ID NO: | CDR-H2 SEQ ID NO: | CDR-H3 SEQ ID NO: | CDR-L1 SEQ ID NO: | CDR-L2 SEQ ID NO: | CDR-L3 SEQ ID NO: |
|---|---|---|---|---|---|---|
| NK77.1_CD70_DB01_C03 | 428 | 502 | 576 | 668 | 742 | 816 |
| NK77.2_CD70_DB01_D02 | 429 | 503 | 577 | 669 | 743 | 817 |
| NK77.3_CD70_DB01_E06 | 430 | 504 | 578 | 670 | 744 | 818 |
| NK77.4_CD70_DB01_G04 | 431 | 505 | 579 | 671 | 745 | 819 |
| NK77.5_CD70_DB01_G05 | 432 | 506 | 580 | 672 | 746 | 820 |
| NK77.6_CD70_DB01_G07 | 433 | 507 | 581 | 673 | 747 | 821 |
| NK77.7_CD70_DB01_G11 | 434 | 508 | 582 | 674 | 748 | 822 |
| NK77.9_CD70_DB02_A03 | 435 | 509 | 583 | 675 | 749 | 823 |
| NK77.10_CD70_DB02_A04 | 436 | 510 | 584 | 676 | 750 | 824 |
| NK77.11_CD70_DB02_A05 | 437 | 511 | 585 | 677 | 751 | 825 |
| NK77.12_CD70_DB02_A06 | 438 | 512 | 586 | 678 | 752 | 826 |
| NK77.13_CD70_DB02_A07 | 439 | 513 | 587 | 679 | 753 | 827 |
| NK77.14_CD70_DB02_A08 | 440 | 514 | 588 | 680 | 754 | 828 |
| NK77.15_CD70_DB02_A09 | 441 | 515 | 589 | 681 | 755 | 829 |
| NK77.16_CD70_DB02_A11 | 442 | 516 | 590 | 682 | 756 | 830 |
| NK77.17_CD70_DB02_B06 | 443 | 517 | 591 | 683 | 757 | 831 |
| NK77.18_CD70_DB02_B09 | 444 | 518 | 592 | 684 | 758 | 832 |
| NK77.19_CD70_DB02_C03 | 445 | 519 | 593 | 685 | 759 | 833 |
| NK77.20_CD70_DB02_C04 | 446 | 520 | 594 | 686 | 760 | 834 |
| NK77.22_CD70_DB02_C07 | 447 | 521 | 595 | 687 | 761 | 835 |
| NK77.24_CD70_DB02_D02 | 448 | 522 | 596 | 688 | 762 | 836 |
| NK77.25_CD70_DB02_D04 | 449 | 523 | 597 | 689 | 763 | 837 |
| NK77.26_CD70_DB02_D10 | 450 | 524 | 598 | 690 | 764 | 838 |
| NK77.27_CD70_DB02_D11 | 451 | 525 | 599 | 691 | 765 | 839 |
| NK77.28_CD70_DB02_E04 | 452 | 526 | 600 | 692 | 766 | 840 |
| NK77.29_CD70_DB02_F06 | 453 | 527 | 601 | 693 | 767 | 841 |
| NK77.31_CD70_DB02_F08 | 454 | 528 | 602 | 694 | 768 | 842 |
| NK77.32_CD70_DB02_G07 | 455 | 529 | 603 | 695 | 769 | 843 |
| NK77.33_CD70_DB02_H04 | 456 | 530 | 604 | 696 | 770 | 844 |
| NK77.34_CD70_DB02_H05 | 457 | 531 | 605 | 697 | 771 | 845 |
| NK77.35_CD70_DB02_H08 | 458 | 532 | 606 | 698 | 772 | 846 |
| NK77.36_CD70_DB03_A06 | 459 | 533 | 607 | 699 | 773 | 847 |
| NK77.37_CD70_DB03_A07 | 460 | 534 | 608 | 700 | 774 | 848 |
| NK77.38_CD70_DB03_A08 | 461 | 535 | 609 | 701 | 775 | 849 |
| NK77.39_CD70_DB03_A09 | 462 | 536 | 610 | 702 | 776 | 850 |
| NK77.40_CD70_DB03_A11 | 463 | 537 | 611 | 703 | 777 | 851 |
| NK77.41_CD70_DB03_A12 | 464 | 538 | 612 | 704 | 778 | 852 |

Figure 50B cont.

| scFv | CDR-H1 SEQ ID NO: | CDR-H2 SEQ ID NO: | CDR-H3 SEQ ID NO: | CDR-L1 SEQ ID NO: | CDR-L2 SEQ ID NO: | CDR-L3 SEQ ID NO: |
|---|---|---|---|---|---|---|
| NK77.42_CD70_DB03_B01 | 465 | 539 | 613 | 705 | 779 | 853 |
| NK77.43_CD70_DB03_B04 | 466 | 540 | 614 | 706 | 780 | 854 |
| NK77.44_CD70_DB03_B06 | 467 | 541 | 615 | 707 | 781 | 855 |
| NK77.45_CD70_DB03_B09 | 468 | 542 | 616 | 708 | 782 | 856 |
| NK77.46_CD70_DB03_C05 | 469 | 543 | 617 | 709 | 783 | 857 |
| NK77.47_CD70_DB03_D11 | 470 | 544 | 618 | 710 | 784 | 858 |
| NK77.48_CD70_DB03_E01 | 471 | 545 | 619 | 711 | 785 | 859 |
| NK77.49_CD70_DB03_E03 | 472 | 546 | 620 | 712 | 786 | 860 |
| NK77.50_CD70_DB03_E09 | 473 | 547 | 621 | 713 | 787 | 861 |
| NK77.51_CD70_DB03_F02 | 474 | 548 | 622 | 714 | 788 | 862 |
| NK77.52_CD70_DB03_F05 | 475 | 549 | 623 | 715 | 789 | 863 |
| NK77.53_CD70_DB03_F06 | 476 | 550 | 624 | 716 | 790 | 864 |
| NK77.54_CD70_DB03_F09 | 477 | 551 | 625 | 717 | 791 | 865 |
| NK77.55_CD70_DB03_F12 | 478 | 552 | 626 | 718 | 792 | 866 |
| NK77.56_CD70_DB03_G06 | 479 | 553 | 627 | 719 | 793 | 867 |
| NK77.57_CD70_DB03_G11 | 480 | 554 | 628 | 720 | 794 | 868 |
| NK77.58_CD70_DB03_H08 | 481 | 555 | 629 | 721 | 795 | 869 |
| NK77.59_CD70_DB03_H10 | 482 | 556 | 630 | 722 | 796 | 870 |
| NK77.60_CD70_DB04_A05 | 483 | 557 | 631 | 723 | 797 | 871 |
| NK77.61_CD70_DB04_A07 | 484 | 558 | 632 | 724 | 798 | 872 |
| NK77.62_CD70_DB04_A10 | 485 | 559 | 633 | 725 | 799 | 873 |
| NK77.63_CD70_DB04_A11 | 486 | 560 | 634 | 726 | 800 | 874 |
| NK77.64_CD70_DB04_B03 | 487 | 561 | 635 | 727 | 801 | 875 |
| NK77.65_CD70_DB04_B05 | 488 | 562 | 636 | 728 | 802 | 876 |
| NK77.66_CD70_DB04_B07 | 489 | 563 | 637 | 729 | 803 | 877 |
| NK77.67_CD70_DB04_C01 | 490 | 564 | 638 | 730 | 804 | 878 |
| NK77.68_CD70_DB04_C04 | 491 | 565 | 639 | 731 | 805 | 879 |
| NK77.69_CD70_DB04_C06 | 492 | 566 | 640 | 732 | 806 | 880 |
| NK77.70_CD70_DB04_C07 | 493 | 567 | 641 | 733 | 807 | 881 |
| NK77.71_CD70_DB04_D02 | 494 | 568 | 642 | 734 | 808 | 882 |
| NK77.72_CD70_DB04_D05 | 495 | 569 | 643 | 735 | 809 | 883 |
| NK77.73_CD70_DB04_D07 | 496 | 570 | 644 | 736 | 810 | 884 |
| NK77.74_CD70_DB04_D08 | 497 | 571 | 645 | 737 | 811 | 885 |
| NK77.75_CD70_DB04_D10 | 498 | 572 | 646 | 738 | 812 | 886 |
| NK77.85_CD70_DB03_B02 | 499 | 573 | 647 | 739 | 813 | 887 |
| NK77.86_CD70_DB04_A06 | 500 | 574 | 648 | 740 | 814 | 888 |
| NK77.87_CD70_DB04_A09 | 501 | 575 | 649 | 741 | 815 | 889 |

| NK Plasmid Number | KD (nM) | NKM34 Blocking | Tonic CD69 (MFI) | Tonic CD25 (MFI) | Expression (%) | Activation CD69 (MFI) | Activation CD25 (MFI) | High Flag Act/Tonic 69 Ratio | High Flag Act/Tonic 25 Ratio | Low Flag Trimer MFI |
|---|---|---|---|---|---|---|---|---|---|---|
| NK77.11_CD70_DB02_A05 | 24.34 | Blocker Strong | 288 | 81.5 | 63.2 | 6301 | 1921 | 21.9 | 24 | 143 |
| NK77.71_CD70_DB04_D02 | 11.84 | Blocker Strong | 285 | 155 | 8.66 | 5427 | 2309 | 19.0 | 14.9 | 249 |
| NK77.58_CD70_DB03_H08 | 9.65 | Blocker Strong | 289 | 135 | 8.4 | 5488 | 2191 | 19.0 | 16.2 | 191 |
| NK77.73_CD70_DB04_D07 | 2.62 | Blocker Strong | 215 | 131 | 9.42 | 4054 | 1757 | 18.9 | 13.4 | 149 |
| NK77.17_CD70_DB02_B06 | 3.87 | Blocker Strong | 415 | 86.9 | 60.7 | 7288 | 2519 | 17.6 | 29 | 125 |
| NK77.16_CD70_DB02_A11 | 8.57 | Blocker Strong | 297 | 76.1 | 58.1 | 5090 | 1423 | 17.1 | 19 | 161 |
| NK77.44_CD70_DB03_B06 | 31.69 | Blocker Strong | 290 | 71.7 | 58.8 | 4883 | 1124 | 16.8 | 16 | 142 |
| NK77.31_CD70_DB02_F08 | 5.56 | Blocker | 299 | 61.5 | 73.3 | 4760 | 1439 | 15.9 | 23 | 116 |
| NK77.65_CD70_DB04_B05 | 0.62 | Blocker Strong | 362 | 161 | 2.89 | 2844 | 844 | 7.9 | 5.2 | 253 |
| NK77.55_CD70_DB03_F12 | 8.57 | Neg | 669 | 178 | 2.26 | 4806 | 1262 | 7.2 | 7.1 | 256 |

Dnr 451 CD70 KO

Figure 51B

| Construct (Dnr 451 CD70 KO) | Titer | CD70 expression (Day 10) | CAR Expression (Day 10) |
|---|---|---|---|
| NK77.55 | 1.03E+06 | 38.8% | 24.6% |
| NK77.58 | 1.40E+06 | 7.11% | 40.4% |
| NK77.65 | 5.95E+05 | 38.8% | 20.0% |
| NK77.71 | 1.50E+06 | 2.52% | 45.6% |
| NK77.73 | 9.17E+05 | 31.9% | 8.74% |
| NK8 | 1.84E+06 | 57.9% | 0.14% |

B

| Construct | Titer | CD70 expression (Day 10) | CAR Expression (Day 10) |
|---|---|---|---|
| NK77.55 | 1.03E+06 | 0.025% | 85.3% |
| NK77.58 | 1.40E+06 | 0.013% | 96.0% |
| NK77.65 | 5.95E+05 | 0.24% | 75.6% |
| NK77.71 | 1.50E+06 | 0.011% | 97.7% |
| NK77.73 | 9.17E+05 | 0.00% | 92.0% |
| EPNT | - | 16.4% | - |
| NK71 | 1.20E+06 | 0.004% | 89.8% |

C

D

| Construct | $EC_{50}$ |
|---|---|
| NK77.55 | 0.1544 |
| NK77.58 | 0.1618 |
| NK77.65 | 0.1340 |
| NK77.71 | 0.2255 |
| NK77.73 | 0.2126 |
| NT | 0.2016 |
| NK71 | 0.2560 |

A

B

D

E

1:8 E:T

F

A

B

C

1:4 E:T 786-O (GFP)

D

NK77.31
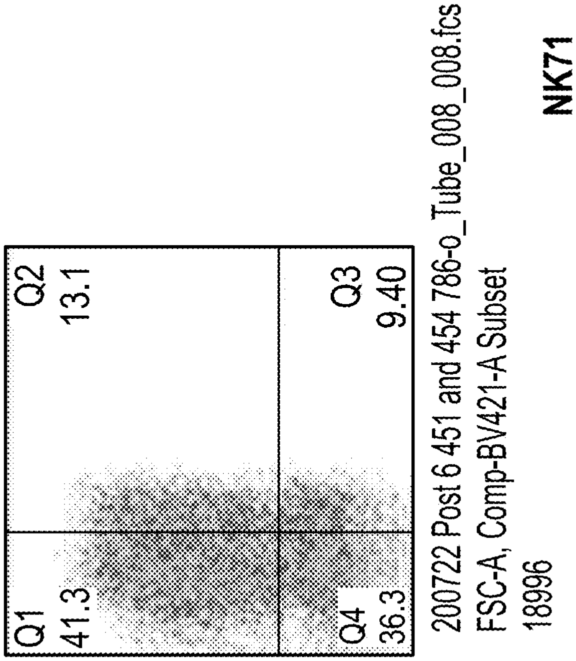
NK77.44
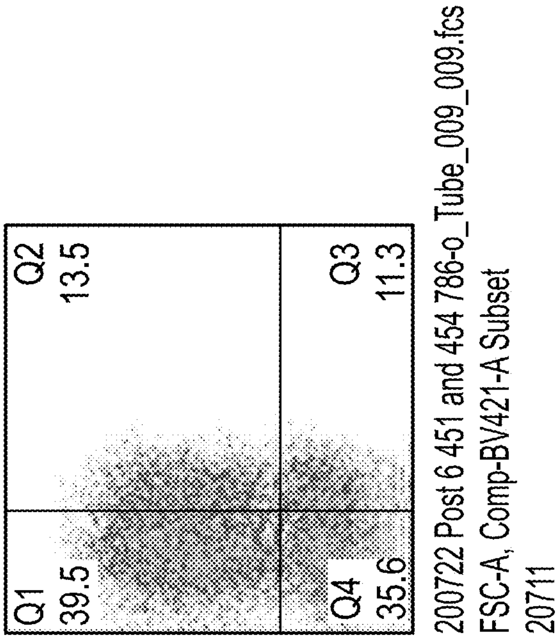
NK71
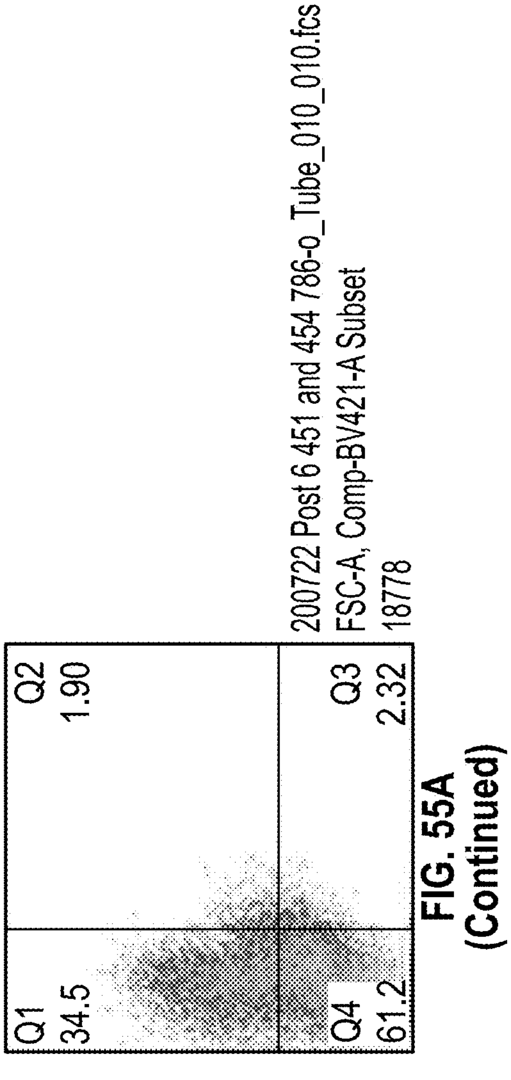
FIG. 55A
(Continued)

B

C

| Construct | Titer | CD70 expression (Day 10) | CAR Expression (Day 10) | EC50 |
|---|---|---|---|---|
| NK77.11 | 2.85E+06 | 0.84% | 45% | 0.5154 |
| NK77.16 | 3.15E+06 | 7.21% | 54.7% | 0.6104 |
| NK77.17 | 2.88E+06 | 0.22% | 53.7% | 0.5257 |
| NK77.31 | 3.51E+06 | 9.4% | 49% | 0.6293 |
| NK77.44 | 3.57E+06 | 11.3 | 54% | 1.513 |
| EPNT | - | 77.8% | - | - |
| NK71 | 1.20E+06 | 2.32% | 37.5% | 0.8364 |

D

E:T=1:2

E

F

G

H

J

E:T=1:4

K

E:T=1:4

E:T=1:4

M

NK77.11
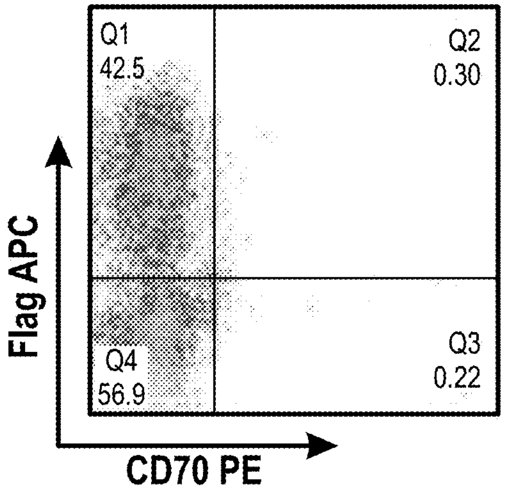
200722 Post 6 451 and 454 786-o_Tube_016_016.fcs FSC-A, Comp-BV421-A Subset 16899
NK77.16
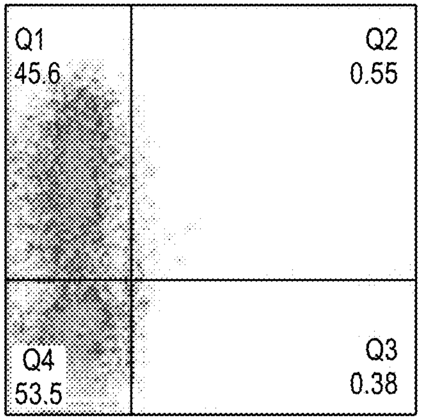
200722 Post 6 451 and 454 786-o_Tube_017_017.fcs
FSC-A, Comp-BV421-A Subset 17196
NK77.17
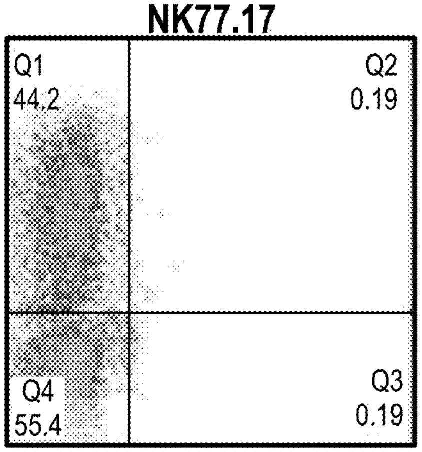
200722 Post 6 451 and 454 786-o_Tube_018_018.fcs
FSC-A, Comp-BV421-A Subset 16697
NK77.31
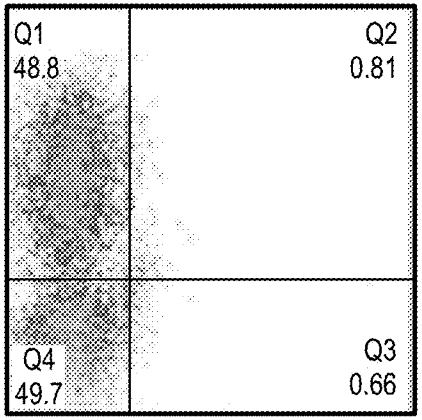
200722 Post 6 451 and 454 786-o_Tube_019_019.fcs
FSC-A, Comp-BV421-A Subset 16086
FIG. 56A
(Continued)

B

C

| Construct | Titer | CD70 expression (Day 10) | CAR Expression (Day 10) | $EC_{50}$ |
|---|---|---|---|---|
| NK77.11 | 2.85E+06 | 0.22% | 41.6% | 0.6067 |
| NK77.16 | 3.15E+06 | 0.3% | 44.4% | 0.7273 |
| NK77.17 | 2.88E+06 | 0.19% | 42.9% | 0.6941 |
| NK77.31 | 3.51E+06 | 0.66% | 48.4% | 0.6193 |
| NK77.44 | 3.57E+06 | 0.70% | 45.3% | 0.9637 |
| EPNT | - | 62.8% | - | - |
| NK71 | 1.20E+06 | 0.28% | 36.4% | 0.786 |

E

F

E:T=1:4

G

E:T=1:4

E:T=1:8

J

E:T=1:8

A

B

Count normalized to Day0 c

G

H

A

B

C

D

1:4 E:T ACHN at 51 hours

* Incucyte errors at 51 hours

E

F

RAW count

G

H

B

| Construct | Titer | CD70 expression (Day 10) | CAR Expression (Day 10) |
|---|---|---|---|
| EPNT | - | 26.1% | - |
| NK71 | 1.20E+06 | 0.51% | 80.2% |
| NK77.11 | 2.85E+06 | 1.06% | 92.3% |
| NK77.16 | 3.15E+06 | 0.98% | 83.0% |
| NK77.17 | 2.88E+06 | 0.66% | 93.5% |
| NK77.31 | 3.51E+06 | 2.43% | 85.0% |
| NK77.44 | 3.57E+06 | 1.06% | 78.1% |
| NK77.55 | 1.03E+06 | 1.91% | 77.8% |
| NK77.58 | 1.40E+06 | 1.25% | 97.5% |
| NK77.65 | 5.95E+05 | 1.84% | 77.2% |
| NK77.71 | 1.50E+06 | 0.73% | 98.1% |
| NK77.73 | 9.17E+05 | 1.31% | 88.6% |

C

D

Cytotoxicity assay EC50 donor 451 CD70-1 KO

| Construct | %CAR+ | EC50 |
|---|---|---|
| NK77.11 | 92.3 | 0.5146 |
| NK77.16 | 83 | 0.4203 |
| NK77.17 | 93.5 | 0.4342 |
| NK77.31 | 85 | 0.3428 |
| NK77.44 | 78.1 | 0.3438 |
| NK77.55 | 77.8 | 0.3677 |
| NK77.58 | 97.5 | 0.3292 |
| NK77.65 | 77.2 | 0.3914 |
| NK77.71 | 98.1 | 0.3022 |
| NK77.73 | 88.6 | 0.3703 |
| NK71 | 80.2 | 0.3233 |
| EPNT | | 2.343 |

A

B

C

D

1:2 E:T ACHN

E

1:2 E:T ACHN

F

G

1:2 E:T ACHN at 51 hours

1:4 E:T 786-O

J

K

1:4 E:T ACHN

M

1:4 E:T ACHN

N

0

1:4 E:T ACHN at 66 hours

P

C

| Construct | Titer | CD70 expression (Day 10) | CAR Expression (Day 10) |
|---|---|---|---|
| EPNT | - | 31.8% | - |
| NK71 | 1.20E+06 | 0.009% | 84.9% |
| NK77.11 | 2.85E+06 | 0.19% | 88.5% |
| NK77.16 | 3.15E+06 | 0.07% | 88.7% |
| NK77.17 | 2.88E+06 | 0.13% | 88.5% |
| NK77.31 | 3.51E+06 | 1.07% | 89.2% |
| NK77.44 | 3.57E+06 | 0.06% | 88.5% |
| NK77.55 | 1.03E+06 | 0.86% | 72.3% |
| NK77.58 | 1.40E+06 | 0.03% | 92.1% |
| NK77.65 | 5.95E+05 | 0.64% | 68.7% |
| NK77.71 | 1.50E+06 | 0.03% | 91.4% |
| NK77.73 | 9.17E+05 | 0.71% | 82.9% |

D

F

CAR MFI Week 1

E

CAR% Week 1

H

CAR MFI Week 2

G

CAR% Week 2

I

CAR% Week 3

J

CAR MFI Week 3

K

L

M

N

A

A

786-O 1:8 E:T

B

ACHN 1:8 E:T

FIG. 64C

Dnr 451

| | CAR% | MFI |
|---|---|---|
| NK77.11 trimer | 84.3 | 4303 |
| NK77.11 trimer-1 | 86.8 | 4644 |
| NK7.16 trimer-1 | 79 | 3832 |
| NK77.16 trimer | 79.6 | 3865 |
| NK77.17 trimer | 76.7 | 2608 |
| NK77.17 trimer-1 | 79.3 | 2715 |
| NK77.58 trimer | 87.7 | 3274 |
| NK77.58 trimer-1 | 88.9 | 3309 |
| NK77.71 trimer | 90.9 | 5190 |
| NK77.71 trimer-1 | 91.4 | 5039 |
| NK71 trimer | 59.2 | 1220 |
| NK71 trimer-1 | 56.5 | 1225 |
| EPNT | 0.39 | 832 |
| | 0.58 | 960 |

FIG. 64D

Dnr 512

| | CAR% | MFI |
|---|---|---|
| NK77.11 trimer | 89.4 % | 3415 |
| NK77.11 trimer-1 | 89.6 % | 3763 |
| NK7.16 trimer-1 | 81.9 % | 2620 |
| NK77.16 trimer | 80.5 % | 2473 |
| NK77.17 trimer | 86.9 % | 2040 |
| NK77.17 trimer-1 | 86.8 % | 2305 |
| NK77.58 trimer | 92.9 % | 2205 |
| NK77.58 trimer-1 | 92.6 % | 2557 |
| NK77.71 trimer | 93.0 % | 4187 |
| NK77.71 trimer-1 | 93.5 % | 4441 |
| NK71 trimer | 59.5 % | 700 |
| NK71 trimer-1 | 59.7 % | 713 |
| EPNT | 0.73 % | 669 |
| CD70KO | 0.31 % | 684 |
| EPNT-1 | 0.71 % | 746 |
| CD70KO-1 | 0.25 % | 833 |

Week1 post transduction

FIG. 64I

Dnr 451

| | CD70% | MFI |
|---|---|---|
| Nk77.11 CD70 | 0 | 0 |
| NK77.11 CD70-1 | 0.052 | 669 |
| NK77.16 CD70 | 0.097 | 307 |
| NK77.16 CD70-1 | 0.078 | 137 |
| Nk77.17 CD70 | 0.037 | 153 |
| NK77.17 CD70-1 | 0.33 | 163 |
| NK77.58 CD70 | 0.045 | 165 |
| NK77.58 CD70-1 | 0.029 | 133 |
| NK77.71 CD70 | 0 | 0 |
| NK77.71 CD70-1 | 0.03 | 144 |
| NK71 CD70 | 0 | 0 |
| NK71CD70-1 | 0.086 | 171 |
| EPNTCD70 | 77.8 | 534 |
| EPNT Cd70-1 | 69.6 | 615 |

FIG. 64J

Dnr 512

| | CD70% | MFI |
|---|---|---|
| Nk77.11 CD70 | 0.72 % | 99.7 |
| NK77.11 CD70-1 | 0.20 % | 199 |
| NK77.16 CD70 | 0.90 % | 95.3 |
| NK77.16 CD70-1 | 0.70 % | 97.4 |
| Nk77.17 CD70 | 0.079 % | 187 |
| NK77.17 CD70-1 | 0.059 % | 121 |
| NK77.58 CD70 | 0.12 % | 129 |
| NK77.58 CD70-1 | 0.12 % | 125 |
| NK77.71 CD70 | 0.094 % | 224 |
| NK77.71 CD70-1 | 0.041 % | 274 |
| NK71 CD70 | 2.33 % | 347 |
| NK71CD70-1 | 0.11 % | 148 |
| EPNTCD70 | 74.4 % | 331 |
| EPNT Cd70-1 | 82.6 % | 331 |

Week1 post transduction

FIG. 65C

| Dnr451 | | | | | |
| --- | --- | --- | --- | --- | --- |
| Construct | Titer | CAR (MFI) | | CAR(%) | |
| EPNT | - | 2033 | 2671 | 0.45 | 0.65 |
| CD70KO NT | - | 2661 | 1509 | 0.27 | 0.44 |
| NK71 | 1.20E+06 | 2245 | 2298 | 48.7 | 52.2 |
| NK77.11 | 2.32E+06 | 7359 | 7530 | 84.4 | 84.4 |
| NK77.16 | 1.38E+06 | 6371 | 6637 | 74.3 | 75.981 |
| NK77.17 | 2.31E+06 | 4652 | 4862 | 77 | 77.6 |
| NK77.58 | 1.81E+06 | 5562 | 5738 | 89.1 | 89.4 |
| NK77.71 | 2.25E+06 | 7843 | 7984 | 91.2 | 90.5 |

FIG. 65D

| Dnr512 | | | | | |
| --- | --- | --- | --- | --- | --- |
| Construct | Titer | CAR (MFI) | | CAR(%) | |
| EPNT | - | 1712 | 1885 | 0.0049 | 0.004 |
| CD70KO NT | - | 1604 | 1966 | 0.00093 | 0.0023 |
| NK71 | 1.20E+06 | 1989 | 2072 | 0.294 | 0.345 |
| NK77.11 | 2.32E+06 | 6435 | 6525 | 0.825 | 0.814 |
| NK77.16 | 1.38E+06 | 5259 | 5257 | 0.72 | 0.692 |
| NK77.17 | 2.31E+06 | 4428 | 4489 | 0.778 | 0.766 |
| NK77.58 | 1.81E+06 | 4280 | 4515 | 0.856 | 0.856 |
| NK77.71 | 2.25E+06 | 6731 | 7229 | 0.905 | 0.911 |

Week 2 post transduction

Week 2 post transduction

FIG. 65I

| Dnr451 | | | CD70 Expression | |
|---|---|---|---|---|
| Construct | CD70 MFI (Day 29) | | (D29) | |
| EPNT | 1604 | 1491 | 36.8 | 38 |
| NK71 | 921 | 967 | 0.059 | 0.99 |
| NK77.11 | 1004 | 1004 | 0.88 | 0.69 |
| NK77.16 | 1101 | 967 | 0.24 | 0.19 |
| NK77.17 | 1054 | 993 | 0.4 | 0.89 |
| NK77.58 | 1011 | 1022 | 0.39 | 0.54 |
| NK77.71 | 989 | 1086 | 0.52 | 0.38 |

FIG. 65J

| Dnr512 | | | CD70 Expression | |
|---|---|---|---|---|
| Construct | CD70 MFI (Day 29) | | (D29) | |
| EPNT | 1354 | 1405 | 20.3 | 24.5 |
| NK71 | 932 | 989 | 0.038 | 1.58 |
| NK77.11 | 967 | 1069 | 0.34 | 0.44 |
| NK77.16 | 1142 | 966 | 0.13 | 0.12 |
| NK77.17 | 982 | 959 | 0.41 | 0.28 |
| NK77.58 | 1058 | 976 | 0.29 | 0.33 |
| NK77.71 | 1021 | 962 | 0.37 | 0.24 |

Week 2 post transduction

Donor 451 week 3 post-transduction

Donor 451 week 3 post-transduction

Donor 512 week 3 post-transduction

Donor 512 week 3 post-transduction

Figure 66C

| Dnr451 | Titer | CAR % | MFI | CAR % | MFI |
|---|---|---|---|---|---|
| NK77.11 | 2.32E+06 | 78.9 | 7609 | 79.1 | 7438 |
| NK77.16 | 1.38E+06 | 72.5 | 7895 | 73 | 7078 |
| NK77.17 | 2.31E+06 | 68.6 | 4882 | 70.2 | 5043 |
| NK77.58 | 1.81E+06 | 83.3 | 6336 | 81.1 | 6063 |
| NK77.71 | 2.25E+06 | 87 | 9402 | 84.7 | 8676 |
| NK71 | 1.20E+06 | 38.7 | 1653 | 43.5 | 1942 |
| EPNT | - | 1.24 | 135 | 1.22 | 123 |

| Dnr 512 | Titer | CAR % | MFI | CAR % | MFI |
|---|---|---|---|---|---|
| NK77.11 | 2.32E+06 | 80 | 7647 | 81.5 | 8198 |
| NK77.16 | 1.38E+06 | 68.4 | 5975 | 69.5 | 5718 |
| NK77.17 | 2.31E+06 | 74.4 | 5269 | 71.4 | 4921 |
| NK77.58 | 1.81E+06 | 79.8 | 5283 | 78.2 | 5147 |
| NK77.71 | 2.25E+06 | 87.7 | 9054 | 87 | 8522 |
| NK71 | 1.20E+06 | 24.2 | 1114 | 30.1 | 1184 |
| EPNT | - | 0.46 | 143 | 0.86 | 144 |

Week 3 post-transduction

Donor 451 week 3 post-transduction

Donor 512 week 3 post-transduction

FIG. 66H

| | viabiliy | CD70 % | MFI | viability | CD70 % | MFI |
|---|---|---|---|---|---|---|
| NK77.11 | 95.9 | 5.14 | 519 | 96.2 | 6.27 | 557 |
| NK77.16 | 97.8 | 4.54 | 517 | 96.7 | 8.95 | 624 |
| NK77.17 | 98.1 | 4.41 | 484 | 97.9 | 5.48 | 516 |
| NK77.58 | 96.4 | 3.81 | 458 | 97 | 7.98 | 567 |
| NK77.71 | 97.9 | 1.66 | 382 | 97 | 6.88 | 541 |
| NK71 | 96.4 | 1.31 | 373 | 95.7 | 6.82 | 542 |
| EPNT | 93.6 | 24.2 | 1321 | 93.5 | 25.3 | 1356 |

Donor 451

FIG. 66I

| | viabiliy | CD70 % | MFI | viability | CD70 % | MFI |
|---|---|---|---|---|---|---|
| NK77.11 | 98.6 | 4.54 | 578 | 97.8 | 9.88 | 633 |
| NK77.16 | 98.9 | 7.27 | 640 | 98 | 8.08 | 592 |
| NK77.17 | 99 | 4.83 | 504 | 97.6 | 9.04 | 590 |
| NK77.58 | 98.6 | 1.72 | 406 | 97.8 | 6.53 | 522 |
| NK77.71 | 98.5 | 2.39 | 395 | 98 | 1.94 | 381 |
| NK71 | 98.1 | 2.67 | 419 | 96.6 | 3.61 | 449 |
| EPNT | 98.1 | 13.7 | 935 | 97.3 | 18.7 | 1052 |

Donor 512

Week 3 Post-transduction

Donor 451 week 4 Post-transduction

Donor 512 week 4 Post-transduction

FIG. 67C

| Dnr451 | | | | |
|---|---|---|---|---|
| Construct | Viability | Titer | CAR MFI | CAR (%) |
| NK77.11 | 88.80% | 2.32E+06 | 5255 | 65 |
| NK77.16 | 90% | 1.38E+06 | 5032 | 60.9 |
| NK77.17 | 91% | 2.31E+06 | 4094 | 58.2 |
| NK77.58 | 90.40% | 1.81E+06 | 5621 | 72.9 |
| NK77.71 | 90.10% | 2.25E+06 | 7437 | 79.4 |
| NK71 | 89.40% | 1.20E+06 | 2459 | 37.7 |
| EPNT | 83.40% | - | 389 | 5.68 |

FIG. 67D

| Dnr512 | | | | |
|---|---|---|---|---|
| Construct | | Titer | CAR MFI | CAR (%) |
| NK77.11 | 88.90% | 2.32E+06 | 5201 | 69.3 |
| NK77.16 | 88.40% | 1.38E+06 | 4533 | 57.6 |
| NK77.17 | 87.20% | 2.31E+06 | 5585 | 69.6 |
| NK77.58 | 88.90% | 1.81E+06 | 4847 | 74.4 |
| NK77.71 | 89.40% | 2.25E+06 | 8003 | 84.8 |
| NK71 | 85.50% | 1.20E+06 | 2575 | 32 |
| EPNT | 83.40% | - | 187 | 0.42 |

Week 4 Post-transduction

Week 4 Post-transduction

FIG. 67I

| Dnr451 | | |
|---|---|---|
| Construct | CD70 MFI | CD70 (%) |
| NK77.11 | 74.4 | 0 |
| NK77.16 | 73.4 | 0 |
| NK77.17 | 84.1 | 0 |
| NK77.58 | 91.8 | 0 |
| NK77.71 | 83.7 | 0 |
| NK71 | 94.1 | 0 |
| EPNT | 741 | 54.9 |

FIG. 67J

| Dnr512 | | |
|---|---|---|
| Construct | CD70 MFI | CD70 (%) |
| NK77.11 | 71.2 | 0 |
| NK77.16 | 74.2 | 0 |
| NK77.17 | 84.7 | 0 |
| NK77.58 | 81.8 | 0 |
| NK77.71 | 81.2 | 0 |
| NK71 | 32.6 | 0 |
| EPNT | 560 | 37.9 |

Week 4 post-transduction

Trimer CAR + APC/FSC
Week 5 post-transduction

Week 5 post-transduction

FIG. 68C

| Dnr451 | CAR % | MFI |
|---|---|---|
| NK77.11 | 67.1 | 7730 |
| NK77.16 | 63.2 | 7615 |
| NK77.17 | 53.5 | 5145 |
| NK77.58 | 70.4 | 6370 |
| NK77.71 | 76.7 | 8643 |
| NK71 | 4.05 | 782 |
| EPNT | 0.34 | 345 |

FIG. 68D

| Dnr512 | CAR % | MFI |
|---|---|---|
| NK77.11 | 70.6 | 7569 |
| NK77.16 | 58.1 | 6297 |
| NK77.17 | 59.3 | 5659 |
| NK77.58 | 64.3 | 4842 |
| NK77.71 | 76.3 | 7910 |
| NK71 | 4.63 | 845 |
| EPNT | 0.13 | 281 |

Week 5 post-transduction

Week 5 post-transduction

Figure 68I

Donor 451

| | CD70 % | MFI |
|---|---|---|
| NK77.11 | 0.019 | 114 |
| NK77.16 | 0 | 115 |
| NK77.17 | 0 | 107 |
| NK77.58 | 0 | 105 |
| NK77.71 | 0.057 | 109 |
| NK71 | 0.047 | 148 |
| EPNT | 27 | 652 |

Donor 512

| | CD70 % | MFI |
|---|---|---|
| NK77.11 | 0 | 121 |
| NK77.16 | 0.031 | 116 |
| NK77.17 | 0 | 113 |
| NK77.58 | 0.28 | 114 |
| NK77.71 | 0.031 | 129 |
| NK71 | 0.8 | 192 |
| EPNT | 54.6 | 1201 |

Week 5 post-transduction

Trimer CAR + APC/FSC
Untransduced
NK71
NK77.71
NK77.58
NK77.17
NK77.10
NK77.11
Dox451 Trimer+APC 2nd
APC 2nd only Ctrl
Week 7 post-transduction Week 7 post-transduction FIG. 69C
| Dnr451 | viability % | CAR% | MFI |
|---|---|---|---|
| NK77.11 | 3.06 | 79.4 | 15878 |
| NK77.16 | 9.98 | 72.7 | 11274 |
| NK77.17 | 15.8 | 59.6 | 6430 |
| NK77.58 | 19.9 | 81 | 9414 |
| NK77.71 | 11.3 | 86.1 | 17051 |
| NK71 | 4.91 | 20.6 | 792 |
| EPNT | 0 | 0 | 0 |
| Dnr 512 | | | |
| NK77.11 | 27.5 | 87.4 | 10774 |
| NK77.16 | 33.8 | 76.2 | 8595 |
| NK77.17 | 63 | 70.1 | 7270 |
| NK77.58 | 59.2 | 79 | 6404 |
| NK77.71 | 51.3 | 92.8 | 12061 |
| NK71 | 5.14 | 25.6 | 511 |
| EPNT | 0.26 | 2.37 | 164 |
FIG. 69D
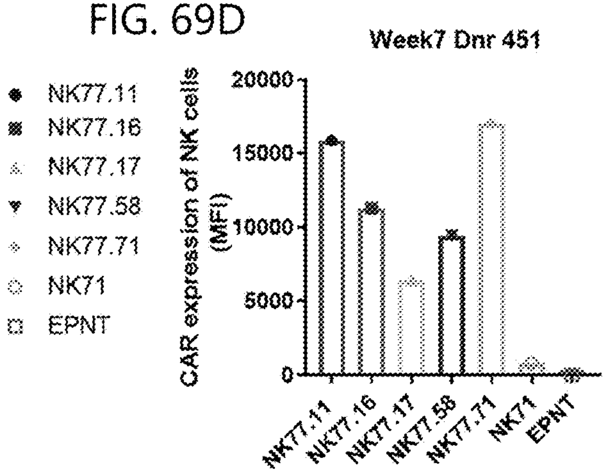
FIG. 69E
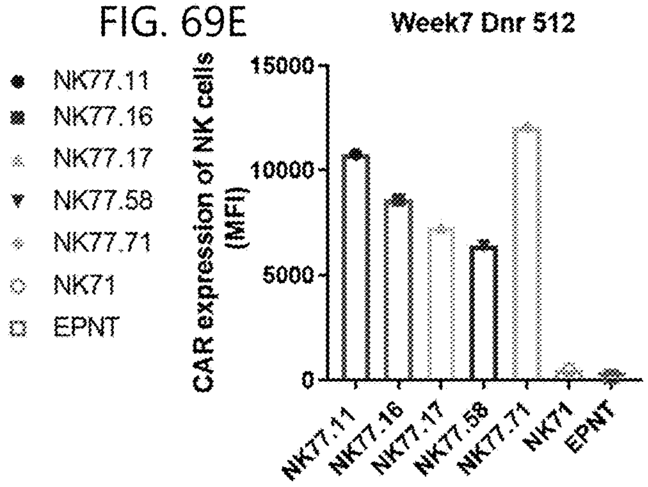
Week 7 post-transduction Week 7 post-transduction

Figure 69H

| Dnr451 | CD70% | MFI |
|---|---|---|
| NK77.11 | 0 | 87.9 |
| NK77.16 | 0 | 96.6 |
| NK77.17 | 0 | 97.6 |
| NK77.58 | 0 | 98.1 |
| NK77.71 | 0 | 93.6 |
| NK71 | 0 | 86.9 |
| EPNT | 0 | 45.4 |
| Dnr 512 | | |
| NK77.11 | 0 | 82.9 |
| NK77.16 | 0 | 91.3 |
| NK77.17 | 0 | 87.8 |
| NK77.58 | 0 | 88.3 |
| NK77.71 | 0 | 88.4 |
| NK71 | 0.35 | 115 |
| EPNT | 16.7 | 295 |

Week 7 post-transduction

Both 786-O and ACHN secret GMCSF in vitro.

GMCSF secretion of NK451 increased slightly from day14 to day 28 while it decreased in the co-culture of NK512 and 786-O.

Nk77.71, 58 and 17 CAR NK cells are the top 3 producing GMCSF at day3 during co-culture with 786-O or ACHN Both 786-O and ACHN secret TNF-a in vitro.

TNF-a secretion of NK451 was stable or increased slightly from day14 to day 28 while it decreased in the co-culture of NK512 and 786-O.

NK77.71, 58 and 17 CAR NK cells are the top 3 producing TNF-a at day3 during co-culture with 786-O or ACHN Dnr512
Normalized to 100% CAR
Day 14

NK512 ACHN-O 1:4

NK512 ACHN 1:8

NK512 786-O 1:8

NK512 ACHN-O 1:4

NK512 786-O 1:4

5K cells/well
for all Tx and
EPNP
20K for tumor
alone

NK512 ACHN 1:8

NK512 786-O 1:8

2.5K cells/well
for all Tx and
EPNP
20K for tumor
alone

D21 786-O 72h 1 to 4 (prior to rechallenge)

72h 1 to 8 (prior to rechallenge)

D21 786-O

Post rechallenge D6 1 to 4

Post rechallenge D6 1 to 8

D21 ACHN 72h 1 to 4 (prior to rechallenge)

72h 1 to 8 (prior to rechallenge)

D21 ACHN

Post rechallenge
D6 1 to 4

Post rechallenge
D6 1 to 8

D28 786-O 72h 1 to 4 (prior to rechallenge)

72h 1 to 8 (prior to rechallenge)

D28 786-O

Post rechallenge
D6 1 to 4

Post rechallenge
D6 1 to 8

D28 ACHN 72h 1 to 4 (prior to rechallenge)

72h 1 to 8 (prior to rechallenge)

D28 ACHN

Post rechallenge
D6 1 to 4

Post rechallenge
D6 1 to 8

GENETICALLY MODIFIED NATURAL KILLER CELLS FOR CD70-DIRECTED CANCER IMMUNOTHERAPY

RELATED CASES

This application claims priority to U.S. Provisional Patent Application No. 63/038,645, filed Jun. 12, 2020, U.S. Provisional Patent Application No. 63/090,041, filed Oct. 9, 2020, U.S. Provisional Patent Application No. 63/141,411, filed Jan. 25, 2021, and, U.S. Provisional Patent Application No. 63/201,490, filed Apr. 30, 2021, the entire contents of each of which is incorporated by reference herein.

FIELD

Several embodiments disclosed herein relate to methods and compositions comprising genetically engineered cells for cancer immunotherapy, in particular cells engineered to have reduced expression of certain markers that are also present on target cells. In several embodiments, the present disclosure relates to cells engineered to express chimeric antigen receptors and have reduced expression of one or more markers that enhance the efficacy and/or reduce potential side effects when the cells are used in cancer immunotherapy

BACKGROUND

As further knowledge is gained about various cancers and what characteristics a cancerous cell has that can be used to specifically distinguish that cell from a healthy cell, therapeutics are under development that leverage the distinct features of a cancerous cell. Immunotherapies that employ engineered immune cells are one approach to treating cancers.

INCORPORATION BY REFERENCE OF MATERIAL IN ASCII TEXT FILE

This application incorporates by reference the Sequence Listing contained in the following ASCII text file being submitted concurrently herewith: File name: NKT.056A_ST25.txt; created on Jun. 10, 2021 and is 1,550,526 bytes in size.

SUMMARY

Immunotherapy presents a new technological advancement in the treatment of disease, wherein immune cells are engineered to express certain targeting and/or effector molecules that specifically identify and react to diseased or damaged cells. This represents a promising advance due, at least in part, to the potential for specifically targeting diseased or damaged cells, as opposed to more traditional approaches, such as chemotherapy, where all cells are impacted, and the desired outcome is that sufficient healthy cells survive to allow the patient to live. One immunotherapy approach is the recombinant expression of chimeric receptors in immune cells to achieve the targeted recognition and destruction of aberrant cells of interest.

In some instances a population of immune cells for immunotherapy may express one or more endogenous markers that overlap in scope with those expressed by a tumor cell population. Targeting such a common marker can limit the efficacy of the therapeutic cells, insofar as the therapeutic cells target both the tumor population and other members of the therapeutic cell population. Therefore, in several embodiments, there is provided a population of genetically engineered immune cells, such as natural killer (NK) cells, T cells or combinations thereof, for cancer immunotherapy, comprising a plurality of immune cells that have been expanded in culture, wherein the plurality of immune cells are engineered to express a chimeric antigen receptor (CAR) comprising a tumor binding domain, a transmembrane domain, and a cytotoxic signaling complex, wherein the tumor binding domain targets CD70, wherein the immune cells are genetically edited to express reduced levels of CD70 as compared to a non-edited immune cell that has been expanded in culture, and wherein the reduced CD70 expression was engineered through editing of an endogenous CD70 gene.

In several embodiments, the cells are genetically edited to express reduced levels of a cytokine-inducible SH2-containing (CIS) protein encoded by a CISH gene as compared to a non-edited cell. In several embodiments, the reduced (e.g., diminished, eliminated or otherwise non-detectable) CIS expression was achieved through editing of a CISH gene. Such editing imparts to the edited cells one or more of enhanced expansion capability, enhanced cytotoxicity against target cells, and enhanced persistence, as compared to cells expressing native levels of CIS. In several embodiments, additional edits are made to the cells, such as editing to yield reduced expression levels of an adenosine receptor. In several embodiments, the reduced adenosine receptor expression is achieved through editing of one or more genes encoding said adenosine receptor which results in one or more of enhanced expansion capability, enhanced cytotoxicity against target cells, and enhanced persistence, as compared to cells expressing native levels the adenosine receptor. In several embodiments, the editing and engineering of the cells works in concert in that the polynucleotide encoding the CAR is inserted into the gene that is edited. However, in several embodiments, the editing site does not include the polynucleotide encoding the CAR.

In several embodiments, the tumor binding domain of the CAR comprises a heavy chain variable region (VH), wherein the VH is encoded by a polynucleotide comprising a sequence having at least at least 80%, at least 85%, at least 90%, or at least 95% sequence identity to one or more of the polynucleotides of SEQ ID NOs: 1104, 1053, 1091, 1047, 1106, 1052, 1077, 1064, 1098, and 1088. In several embodiments, the tumor binding domain of the CAR comprises a light chain variable region (VL), wherein the VL is encoded by a polynucleotide comprising a sequence having at least at least 80%, at least 85%, at least 90%, or at least 95% sequence identity to one or more of the polynucleotides of SEQ ID NOs: 1178, 1127, 1165, 1121, 1180, 1126, 1151, 1138, 1171, and 1162. In several embodiments, the tumor binding domain comprises a single chain variable fragment (scFv), wherein the scFv is encoded by a polynucleotide comprising a sequence having at least at least 80%, at least 85%, at least 90%, or at least 95% sequence identity to one or more of the polynucleotides of SEQ ID NOs: 104, 53, 91, 47, 106, 52, 77, 64, 98, and 88.

In several embodiments, the tumor binding domain comprises a heavy chain variable region and a light chain variable region, wherein the heavy chain variable region comprises a CDR-H1, CDR-H2, and CDR-H3, and the light chain variable region comprises a CDR-L1, CDR-L2, and CDR-L3, and wherein the CDR-H1 comprises a sequence having at least at least 80%, at least 85%, at least 90%, or at least 95% sequence identity to one or more sequences selected from SEQ ID NOs: 494, 443, 481, 437, 496, 442, 467, 454, 488, and 478; the CDR-H2 comprises a sequence having at least at least 80%, at least 85%, at least 90%, or at least 95% sequence identity to one or more sequences selected from SEQ ID NOs: 568, 517, 555, 511, 570, 516, 541, 528, 562, and 552; the CDR-H3 comprises a sequence having at least at least 80%, at least 85%, at least 90%, or at least 95% sequence identity to one or more sequences selected from SEQ ID NOs: 642, 591, 629, 585, 644, 590, 615, 602, 636, and 626; the CDR-L1 comprises a sequence having at least at least 80%, at least 85%, at least 90%, or at least 95% sequence identity to one or more sequences selected from SEQ ID NOs: 734, 683, 721, 677, 736, 682, 707, 694, 728, and 718; the CDR-L2 comprises a sequence having at least at least 80%, at least 85%, at least 90%, or at least 95% sequence identity to one or more sequences selected from SEQ ID NOs: 808, 757, 795, 751, 810, 756, 781, 768, 802, and 792; and the CDR-L3 comprises a sequence having at least at least 80%, at least 85%, at least 90%, or at least 95% sequence identity to one or more sequences selected from SEQ ID NOs: 882, 831, 869, 825, 884, 830, 855, 842, 876, and 855.

In several embodiments, the tumor binding domain comprises a VH, wherein the VH comprises an amino acid sequence having at least at least 80%, at least 85%, at least 90%, or at least 95% sequence identity to one or more of the amino acid sequences of SEQ ID NOs: 956, 905, 943, 899, 958, 904, 929, 916, 950, and 940. In several embodiments, the tumor binding domain comprises a VL, wherein the VL comprises an amino acid sequence having at least at least 80%, at least 85%, at least 90%, or at least 95% sequence identity to one or more of the amino acid sequences of SEQ ID NOs: 1030, 979, 1017, 973, 1032, 978, 1003, 990, 1024, and 1014.

In several embodiments, the tumor binding domain comprises an scFv, wherein the scFv comprises an amino acid sequence having at least 80%, at least 85%, at least 90%, or at least 95% sequence identity to one or more of the amino acid sequences of SEQ ID NOs: 296, 245, 283, 239, 298, 244, 269, 256, 290, 280.

In several embodiments, the immune cells are engineered to express membrane bound IL-15 (mbIL15). In several embodiments, the mbIL15 is bicistronically encoded on a polynucleotide encoding the CAR. In several embodiments, the polynucleotide encoding the CAR and the mbIL15 comprises a sequence having at least 80%, at least 85%, at least 90%, or at least 95% sequence identity to one or more of the polynucleotides of SEQ ID NOs: 204, 153, 191, 147, 206, 152, 177, 164, 198, and 188. In several embodiments, the CAR comprises an amino acid sequence having at least 80%, at least 85%, at least 90%, or at least 95% sequence identity to one or more of the amino acid sequences of SEQ ID NOs: 379, 328, 366, 322, 381, 327, 352, 339, 373, and 363. In several embodiments, the mbIL15 is encoded by a sequence having at least 80%, at least 85%, at least 90%, or at least 95% sequence identity to SEQ ID NO: 1188.

In several embodiments, the cytotoxic signaling complex comprises an OX-40 subdomain and a CD3zeta subdomain. In several embodiments, the OX40 subdomain is encoded by a sequence having at least 80%, at least 85%, at least 90%, or at least 95% sequence identity to SEQ ID NO: 5. In several embodiments, the CD3zeta subdomain is encoded by a sequence having at least 80%, at least 85%, at least 90%, or at least 95% sequence identity to SEQ ID NO: 7.

In several embodiments, the expression of CIS by the edits cells is substantially reduced as compared to a cell not edited with respect to CISH. In several embodiments, the edited cells do not express a detectable level of CIS protein.

In several embodiments, the expression of the adenosine receptor is substantially reduced as compared to a cell not edited with respect the adenosine receptor. In several embodiments, the edited cells do not express a detectable level of an adenosine receptor. In several embodiments, the edited adenosine receptor comprises one or more of an A2A adenosine receptor, an A2B adenosine receptor, an A3 adenosine receptor, or an A1 adenosine receptor. In several embodiments, the edited adenosine receptor comprises an A2A adenosine receptor (A2AR). In several embodiments, the cells are further genetically edited to express a reduced level of one or more of a transforming growth factor beta receptor (TGFBR), beta-2 microglobulin (B2M), CIITA (class II major histocompatibility complex transactivator), Natural Killer Group 2, member A (NKG2A) receptor, Cbl proto-oncogene B protein encoded by a CBLB gene, tripartite motif-containing protein 29 protein encoded by a TRIM29 gene, and a suppressor of cytokine signaling 2 protein encoded by a SOCS2 gene as compared to a non-edited NK cell. In several embodiments, the gene editing to reduce expression or the gene editing to induce expression is made using a CRISPR-Cas system. In several embodiments, the CRISPR-Cas system comprises a Cas selected from Cas9, Csn2, Cas4, Cpf1, C2c1, C2c3, Cas13a, Cas13b, Cas13c, CasX, CasY, and combinations thereof. In one embodiment the Cas is Cas9 (optionally reduced activity Cas9).

In several embodiments, the Cas is guided to the CD70 gene by one or more guide RNA having at least 80%, at least 85%, at least 90%, or at least 95% sequence identity to SEQ ID NO: 121, SEQ ID NO: 122, or SEQ ID NO: 123. In several embodiments, the Cas is guided to the CISH gene by one or more guide RNA having at least 80%, at least 85%, at least 90%, or at least 95% sequence identity to SEQ ID NO: 130, SEQ ID NO: 131, SEQ ID NO: 132, SEQ ID NO: 133, or SEQ ID NO: 134. In several embodiments, the Cas is guided to the adenosine receptor gene by one or more guide RNA having at least 80%, at least 85%, at least 90%, or at least 95% sequence identity to SEQ ID NO: 396, SEQ ID NO: 397, or SEQ ID NO: 398. In several embodiments, the Cas is guided to the TGFBR2 gene by one or more guide RNA having at least 80%, at least 85%, at least 90%, or at least 95% sequence identity to SEQ ID NO: 130, SEQ ID NO: 131, SEQ ID NO: 132, SEQ ID NO: 133, or SEQ ID NO: 134.

In several embodiments, the gene editing to reduce expression or the gene editing to induce expression is made using a zinc finger nuclease (ZFN). In alternative embodiments, the gene editing to reduce expression or the gene editing to induce expression is made using a Transcription activator-like effector nuclease (TALEN).

In several embodiments, the immune cells that are engineered and edited comprise NK cells. In several embodiments, the immune cells that are engineered and edited consist of or consist essentially of NK cells.

In several embodiments, there are provided for herein methods of treating cancer in a subject, comprising administering to the subject the population of genetically engineered and edited immune cells, such as NK cells, as provided for herein. In several embodiments, the cancer is renal cell carcinoma, or a metastasis from renal cell carcinoma. Also provided for herein is a use of the genetically engineered and edited immune cells, such as NK cells, as provided for herein, in the treatment of cancer. Additionally provided is a use of the genetically engineered and edited immune cells, such as NK cells, as provided for herein in the manufacture of a medicament for the treatment of cancer.

Additionally provided for herein are methods for treating cancer in a subject comprising, administering to the subject a population of genetically engineered immune cells, comprising a plurality of immune cells, such as NK cells, T cells, or combinations thereof, that have been expanded in culture, wherein the plurality of NK cells is engineered to express a chimeric antigen receptor (CAR) comprising a tumor binding domain, a transmembrane domain, and a cytotoxic signaling complex, wherein the tumor binding domain targets CD70, and wherein the cells are genetically edited to express reduced levels of CD70 as compared to a non-edited cell that has been expanded in culture, and wherein the reduced CD70 expression was engineered through editing of an endogenous CD70 gene.

In several embodiments, the cells are further genetically edited to express reduced levels of a cytokine-inducible SH2-containing (CIS) protein encoded by a CISH gene as compared to a non-edited cell, wherein the reduced CIS expression was engineered through editing of a CISH gene and wherein the genetically edited cells exhibit one or more of enhanced expansion capability, enhanced cytotoxicity against target cells, and enhanced persistence, as compared to cells expressing native levels of CIS. In several embodiments, the cells are also genetically edited to express reduced expression of an adenosine receptor, wherein the reduced adenosine receptor expression was achieved through editing of a gene encoding said adenosine receptor, and wherein the genetically edited cells exhibit one or more of enhanced expansion capability, enhanced cytotoxicity against target cells, and enhanced persistence, as compared to cells expressing native levels the adenosine receptor.

In several embodiments, the tumor binding domain comprises a heavy chain variable region (VH), wherein the VH is encoded by a polynucleotide comprising a sequence having at least 80%, at least 85%, at least 90%, or at least 95% sequence identity to one or more of the polynucleotides of SEQ ID NOs: 1104, 1053, 1091, 1047, 1106, 1052, 1077, 1064, 1098, and 1088 and wherein the tumor binding domain comprises a light chain variable region (VL), wherein the VL is encoded by a polynucleotide comprising a sequence having at least 80%, at least 85%, at least 90%, or at least 95% sequence identity to one or more of the polynucleotides of SEQ ID NOs: 1178, 1127, 1165, 1121, 1180, 1126, 1151, 1138, 1171, and 1162.

In several embodiments of these methods, the tumor binding domain comprises a single chain variable fragment (scFv), wherein the scFv is encoded by a polynucleotide comprising a sequence having at least 80%, at least 85%, at least 90%, or at least 95% sequence identity to one or more of the polynucleotides of SEQ ID NOs: 104, 53, 91, 47, 106, 52, 77, 64, 98, and 88. In several embodiments of these methods, the tumor binding domain comprises a heavy chain variable region and a light chain variable region, wherein the heavy chain variable region comprises a CDR-H1, CDR-H2, and CDR-H3, and the light chain variable region comprises a CDR-L1, CDR-L2, and CDR-L3, and wherein the CDR-H1 comprises a sequence having at least 80%, at least 85%, at least 90%, or at least 95% sequence identity to one or more sequences selected from SEQ ID NOs: 494, 443, 481, 437, 496, 442, 467, 454, 488, and 478; the CDR-H2 comprises a sequence having at least 80%, at least 85%, at least 90%, or at least 95% sequence identity to one or more sequences selected from SEQ ID NOs: 568, 517, 555, 511, 570, 516, 541, 528, 562, and 552; the CDR-H3 comprises a sequence having at least 80%, at least 85%, at least 90%, or at least 95% sequence identity to one or more sequences selected from SEQ ID NOs: 642, 591, 629, 585, 644, 590, 615, 602, 636, and 626; the CDR-L1 comprises a sequence having at least 80%, at least 85%, at least 90%, or at least 95% sequence identity to one or more sequences selected from SEQ ID NOs: 734, 683, 721, 677, 736, 682, 707, 694, 728, and 718; the CDR-L2 comprises a sequence having at least 80%, at least 85%, at least 90%, or at least 95% sequence identity to one or more sequences selected from SEQ ID NOs: 808, 757, 795, 751, 810, 756, 781, 768, 802, and 792; and the CDR-L3 comprises a sequence having at least 80%, at least 85%, at least 90%, or at least 95% sequence identity to one or more sequences selected from SEQ ID NOs: 882, 831, 869, 825, 884, 830, 855, 842, 876, and 855.

In several embodiments of these methods, the tumor binding domain comprises a VH, wherein the VH comprises an amino acid sequence having at least 80%, at least 85%, at least 90%, or at least 95% sequence identity to one or more of the amino acid sequences of SEQ ID NOs: 956, 905, 943, 899, 958, 904, 929, 916, 950, and 940 and wherein the tumor binding domain comprises a VL, wherein the VL comprises an amino acid sequence having at least 80%, at least 85%, at least 90%, or at least 95% sequence identity to one or more of the amino acid sequences of SEQ ID NOs: 1030, 979, 1017, 973, 1032, 978, 1003, 990, 1024, and 1014. In several embodiments of these methods, the tumor binding domain comprises an scFv, wherein the scFv comprises an amino acid sequence having at least 80%, at least 85%, at least 90%, or at least 95% sequence identity to one or more of the amino acid sequences of SEQ ID NOs: 296, 245, 283, 239, 298, 244, 269, 256, 290, 280.

In several embodiments of these methods, the chimeric antigen receptor comprises an OX40 subdomain and a CD3zeta subdomain and the cells are engineered to express membrane bound IL-15 (mbIL15). In several embodiments, the mbIL15 is bicistronically encoded on a polynucleotide encoding the CAR. In several embodiments, the polynucleotide encoding the CAR and the mbIL15 comprises a sequence having at least 80%, at least 85%, at least 90%, or at least 95% sequence identity to one or more of the polynucleotides of SEQ ID NOs: 204, 153, 191, 147, 206, 152, 177, 164, 198, and 188. In several embodiments, the CAR comprises an amino acid sequence having at least 80%, at least 85%, at least 90%, or at least 95% sequence identity to one or more of the amino acid sequences of SEQ ID NOs: 379, 328, 366, 322, 381, 327, 352, 339, 373, and 363. In several embodiments, the OX40 subdomain is encoded by a sequence having at least 80%, at least 85%, at least 90%, or at least 95% sequence identity to SEQ ID NO: 5, wherein the CD3zeta subdomain is encoded by a sequence having at least 80%, at least 85%, at least 90%, or at least 95% sequence identity to SEQ ID NO: 7, and wherein the mbIL15 is encoded by a sequence having at least 80%, at least 85%, at least 90%, or at least 95% sequence identity to SEQ ID NO: 1188.

In several embodiments, expression of CIS is substantially reduced as compared to a cell not edited with respect to CISH and/or wherein the cells do not express a detectable level of CIS protein. In several embodiments, expression of the adenosine receptor is substantially reduced as compared to a cell not edited with respect the adenosine receptor and/or wherein the cells do not express a detectable level of an adenosine receptor. In several embodiments, the adenosine receptor comprises an A2A adenosine receptor, an A2B adenosine receptor, an A3 adenosine receptor, or an A1 adenosine receptor. In several embodiments, the gene editing is made using a CRISPR-Cas system, and wherein the Cas comprises a Cas9 enzyme. In several embodiments, the immune cells that are engineered and edited comprise NK cells. In several embodiments, the immune cells that are engineered and edited consist of or consist essentially of NK cells.

Also provided for herein is a polynucleotide encoding an anti-CD70 chimeric antigen receptor, wherein the CAR comprises an anti-CD70 binding domain, wherein the anti-CD70 binding domain is encoded by a polynucleotide comprising a sequence having at least 95% sequence identity to one or more of SEQ ID NOs: 36-120, 221-229, 1038-1111, 1112-1185, and/or comprises an amino acid sequence having at least 95% sequence identity to one or more of the amino acid sequences of SEQ ID NO: 230-312, 890-963, 964-1037, or a portion thereof capable of generating cytotoxic signals upon binding to CD70 on a target cell. In several embodiments, the polynucleotide further encodes an OX40 domain, wherein the OX40 subdomain is encoded by a sequence having at least 85%, at least 90%, or at least 95% sequence identity to SEQ ID NO: 5, and a CD3zeta domain, wherein the CD3zeta subdomain is encoded by a sequence having at least 85%, at least 90%, or at least 95% sequence identity to SEQ ID NO: 7. In several embodiments, the polynucleotide further encodes mbIL15, wherein the mbIL15 is encoded by a sequence having at least 85%, at least 90%, or at least 95% sequence identity to SEQ ID NO: 1188. In several embodiments, the one or more of SEQ ID NOs: 36-120, 221-229, 1038-1111, or 1112-1185, the polynucleotide encoding OX40, the polynucleotide encoding CD3zeta, and the polynucleotide encoding mbIL15 are arranged in a 5' to 3' orientation within the polynucleotide.

Additionally provided for herein is a method of enhancing the persistence of a population of immune cells to be used in cancer immunotherapy, comprising identifying a target marker on a tumor to be treated, determining if a population of immune cells to be engineered to express a CAR that binds the target marker also endogenously expresses the target marker; editing the genome of the population of immune cells to disrupt the gene encoding the endogenous target marker, and engineering the population of immune cells to express the CAR, wherein the disruption of the endogenous expression of the target marker by the immune cells reduces the ability of the CAR to bind the endogenous target marker on the immune cells, thereby enhancing the persistence of the population of immune cells. In several embodiments, the immune cells are NK cells, T cells, or a combination thereof, wherein the target marker is CD70, and wherein the gene editing is made using a CRISPR-Cas system.

In several embodiments, the method further comprises using a CRISPR-Cas system to disrupt expression of a cytokine-inducible SH2-containing (CIS) protein encoded by a CISH gene and/or further comprising using a CRISPR-Cas system to disrupt expression of an adenosine receptor, wherein the adenosine receptor comprises an A2A adenosine receptor, an A2B adenosine receptor, an A3 adenosine receptor, and/or an A1 adenosine receptor.

Provided for herein, in several embodiments, is an anti-CD70 chimeric antigen receptor (CAR), wherein the CAR comprises an anti-CD70 binding domain, an OX40 domain, and a CD3zeta domain, wherein the anti-CD70 CAR is encoded by a polynucleotide having at least 85%, at least 90%, or at least 95% sequence identity to one or more of SEQ ID NOS: 138-220. Also provided for herein is an anti-CD70 chimeric antigen receptor (CAR), wherein the CAR comprises an anti-CD70 binding domain, an OX40 domain, and a CD3zeta domain wherein the anti-CD70 CAR comprises an amino acid sequence having at least 85%, at least 90%, or at least 95% sequence identity to one or more of the amino acid sequences of SEQ ID NOs: 313-395, or a portion thereof capable of generating cytotoxic signals upon binding to CD70 on a target cell.

Additionally provided for herein is an anti-CD70 binding domain comprising a heavy chain variable region and a light chain variable region, wherein the heavy chain variable region comprises a CDR-H1, CDR-H2, and CDR-H3, and the light chain variable region comprises a CDR-L1, CDR-L2, and CDR-L3, and wherein: the CDR-H1 comprises a sequence having at least 80%, 85%, 90%, 95%, 99%, or 100% sequence identity to a sequence selected from SEQ ID NOs: 428-501; the CDR-H2 comprises a sequence having at least 80%, 85%, 90%, 95%, 99%, or 100% sequence identity to a sequence selected from SEQ ID NOs: 502-575; the CDR-H3 comprises a sequence having at least 80%, 85%, 90%, 95%, 99%, or 100% sequence identity to a sequence selected from SEQ ID NOs: 576-649; the CDR-L1 comprises a sequence having at least 80%, 85%, 90%, 95%, 99%, or 100% sequence identity to a sequence selected from SEQ ID NOs: 668-741; the CDR-L2 comprises a sequence having at least 80%, 85%, 90%, 95%, 99%, or 100% sequence identity to a sequence selected from SEQ ID NOs: 742-815; and the CDR-L3 comprises a sequence having at least 80%, 85%, 90%, 95%, 99%, or 100% sequence identity to a sequence selected from SEQ ID NOs: 816-889. In several embodiments, the heavy chain variable domain is encoded by a nucleic acid sequence having at least 80%, 85%, 90%, 95%, 99%, or 100% sequence identity to any sequence selected from SEQ ID NOs: 1038-1111. In several embodiments, the light chain variable domain is encoded by a nucleic acid sequence having at least 80%, 85%, 90%, 95%, 99%, or 100% sequence identity to any sequence selected from SEQ ID NOs: 1112-1185. Depending on the embodiment, the anti-CD70 binding domain is an antibody, Fab' fragment, F(ab')2 fragment, or scFv. In several embodiments, provided for herein is a CAR comprising the anti-CD70 binding domain disclosed herein. In several embodiments, the CAR further comprises an OX40 subdomain and a CD3zeta subdomain. In several embodiments, there are provided cells, such as immune cells, comprising the anti-CD70 binding domain or the CARs provided for herein. In several embodiments, the cell comprises, consists of, or consists essentially of an NK cell. In several embodiments, the wherein the cell is genetically edited to express a reduced level of CISH, an adenosine receptor, A2A adenosine receptor, A2B adenosine receptor, A3 adenosine receptor, A1 adenosine receptor, A2AR, TGFBR, B2M, CIITA, NKG2A, CBLB, TRIM29, SOCS2, SMAD3, MAPKAPK3, CEACAM1, or DDIT4, or any combination thereof, as compared to a non-edited cell. Also provided for are methods of treating cancer in a subject comprising administering to the subject an anti-CD70 binding domain, a CAR, a cell as provided for herein. Also provided are a use of an anti-CD70 binding domain, a CAR, or a cell as provided for herein for the treatment of cancer and/or in the manufacture of a medicament for the treatment of cancer.

Provided for herein is also a population of genetically engineered immune cells for cancer immunotherapy, comprising a plurality of immune cells that have been expanded in culture, wherein the plurality of immune cells are engineered to express a chimeric antigen receptor (CAR) comprising a tumor binding domain that targets CD70, a transmembrane domain, and a cytotoxic signaling complex, wherein the immune cells are genetically edited to express reduced levels of CD70 as compared to non-edited immune cells that have been expanded in culture, and wherein the reduced CD70 expression was engineered through editing of an endogenous CD70 gene. In several embodiments, the population of immune cells comprises, consists of, or consists essentially of a population of NK cells.

Also provided in several embodiments, is a method of making a population of genetically engineered immune cells for cancer immunotherapy, comprising engineering a population of immune cells to express a CAR that binds a target marker, wherein at least a portion of the population of immune cells also endogenously expresses the target marker; and editing the genome of the population of immune cells to disrupt the gene encoding the endogenous target marker, wherein the disruption of the endogenous expression of the target marker by the immune cells reduces the ability of the CAR to bind the endogenous target marker on the immune cells. In several embodiments, the population of immune cells comprises, consists of, or consists essentially of a population of NK cells.

In several embodiments, there is provided herein a population of genetically engineered natural killer (NK) cells for cancer immunotherapy, comprising a plurality of NK cells that have been expanded in culture, wherein the plurality of NK cells are engineered to express a chimeric antigen receptor (CAR) comprising a tumor binding domain, a transmembrane domain, and a cytotoxic signaling complex, wherein the tumor binding domain targets CD70. In several embodiments, the NK cells are genetically edited to express reduced levels of CD70 as compared to a non-edited NK cell that has been expanded in culture, and wherein the reduced CD70 expression was engineered through editing of an endogenous CD70 gene.

In several embodiments, there are provided methods for treating cancer in a subject comprising, administering to the subject a population of genetically engineered immune cells, comprising a plurality of NK cells that have been expanded in culture, wherein the plurality of NK cells are engineered to express a chimeric antigen receptor (CAR) comprising a tumor binding domain, a transmembrane domain, and a cytotoxic signaling complex, wherein the tumor binding domain targets CD70, wherein the chimeric antigen receptor comprises an OX40 subdomain and a CD3zeta subdomain, wherein the NK cells are genetically edited to express reduced levels of CD70 as compared to a non-edited NK cell that has been expanded in culture, and wherein the reduced CD70 expression was engineered through editing of an endogenous CD70 gene.

In several embodiments, the chimeric antigen receptor cytotoxic signaling complex comprises an OX40 subdomain and a CD3zeta subdomain. In several embodiments, the cells are also genetically engineered to express membrane bound IL-15.

In several embodiments, the NK cells are genetically edited to express reduced levels of a cytokine-inducible SH2-containing (CIS) protein encoded by a CISH gene as compared to a non-engineered NK cell, wherein the reduced CIS expression was engineered through editing of a CISH gene, and wherein the genetically engineered NK cells exhibit one or more of enhanced expansion capability, enhanced cytotoxicity against target cells, and enhanced persistence, as compared to NK cells expressing native levels of CIS. In several embodiments, CISH editing results in substantially reduced expression of CIS as compared to a cell not edited for CISH. In several embodiments, the edited cells do not express a detectable levels of CIS.

In several embodiments, the NK cells are genetically edited to express reduced levels of an adenosine receptor as compared to a non-engineered NK cell, wherein the reduced adenosine receptor expression was engineered through editing of a adenosine receptor encoding gene, and wherein the genetically engineered NK cells exhibit one or more of enhanced expansion capability, enhanced cytotoxicity against target cells, and enhanced persistence, as compared to NK cells expressing native levels of the adenosine receptor. In several embodiments, editing of a gene encoding an adenosine receptor results in substantially reduced expression of the adenosine receptor as compared to a cell not edited for the adenosine receptor. In several embodiments, the edited cells do not express a detectable levels of an adenosine receptor. Depending on the embodiment, the edited gene may encode an A2A adenosine receptor, an A2B adenosine receptor, an A3 adenosine receptor, or an A1 adenosine receptor. In several embodiments, the gene edited encodes an A2A adenosine receptor (A2AR). In some embodiments, more than one of the adenosine receptors are edited.

In several embodiments, CISH and an adenosine receptor encoding gene are edited, resulting in substantially reduced expression of CIS and the adenosine receptor as compared to a cell not edited for CISH and the adenosine receptor. In several embodiments, the edited cells do not express a detectable levels of CIS or the adenosine receptor.

In several embodiments, the tumor binding domain is encoded by a polynucleotide comprising a sequence having at least 85%, at least 90%, or at least 95% sequence identity to one or more of the polynucleotides of SEQ ID NO: 36 to SEQ ID NOs: 120, 221-229, 1038-1111, 1112-1185, and/or comprises an amino acid sequence having at least 85%, at least 90%, or at least 95% sequence identity to one or more of the amino acid sequences of SEQ ID NO: 230-312, 890-963, 964-1037. In several embodiments, the OX40 subdomain is encoded by a sequence having at least 85%, at least 90%, or at least 95% sequence identity to SEQ ID NO: 5. In several embodiments, the OX40 subdomains comprise an amino acid sequence having at least 85%, at least 90%, or at least 95% sequence identity to SEQ ID NO: 6. In several embodiments, the CD3zeta subdomain is encoded by a sequence having at least 85%, at least 90%, at least 95% sequence identity to SEQ ID NO: 7. In several embodiments, the CD3zeta subdomain comprises an amino acid sequence having at least 85%, at least 90%, or at least 95% sequence identity to SEQ ID NO: 8.

In several embodiments, there is provided for herein, an anti-CD70 binding domain comprising a heavy chain variable region and a light chain variable region, wherein the heavy chain variable region comprises a CDR-H1, CDR-H2, and CDR-H3, and the light chain variable region comprises a CDR-L1, CDR-L2, and CDR-L3, and wherein the CDR-H1 comprises a sequence having at least 90%, 95%, 99%, or 100% sequence identity to a sequence selected from SEQ ID NOs: 428-501, the CDR-H2 comprises a sequence having at least 90%, 95%, 99%, or 100% sequence identity to a sequence selected from SEQ ID NOs: 502-575, the CDR-H3 comprises a sequence having at least 90%, 95%, 99%, or 100% sequence identity to a sequence selected from SEQ ID NOs: 576-649, the CDR-L1 comprises a sequence having at least 90%, 95%, 99%, or 100% sequence identity to a sequence selected from SEQ ID NOs: 668-741, the CDR-L2 comprises a sequence having at least 90%, 95%, 99%, or 100% sequence identity to a sequence selected from SEQ ID NOs: 742-815, and the CDR-L3 comprises a sequence having at least 90%, 95%, 99%, or 100% sequence identity to a sequence selected from SEQ ID NOs: 816-889. In several embodiments, the heavy chain variable region comprises an amino acid sequence having at least 90%, 95%, 99%, or 100% sequence identity to any sequence selected from SEQ ID NOs: 890-963. In several embodiments, the light chain variable region comprises an amino acid sequence having at least 95%, 99%, or 100% sequence identity to any sequence selected from SEQ ID NOs: 964-1037. In several embodiments, the: 1) the heavy chain variable region comprises the CDR-H1, CDR-H2, CDR-H3 within SEQ ID NO: 890 and the light chain variable region comprises the CDR-L1, CDR-L2, CDR-L3 within SEQ ID NO: 964; 2) the heavy chain variable region comprises the CDR-H1, CDR-H2, CDR-H3 within SEQ ID NO: 891 and the light chain variable region comprises the CDR-L1, CDR-L2, CDR-L3 within SEQ ID NO: 965; 3) the heavy chain variable region comprises the CDR-H1, CDR-H2, CDR-H3 within SEQ ID NO: 892 and the light chain variable region comprises the CDR-L1, CDR-L2, CDR-L3 within SEQ ID NO: 966; 4) the heavy chain variable region comprises the CDR-H1, CDR-H2, CDR-H3 within SEQ ID NO: 893 and the light chain variable region comprises the CDR-L1, CDR-L2, CDR-L3 within SEQ ID NO: 967; 5) the heavy chain variable region comprises the CDR-H1, CDR-H2, CDR-H3 within SEQ ID NO: 894 and the light chain variable region comprises the CDR-L1, CDR-L2, CDR-L3 within SEQ ID NO: 968; 6) the heavy chain variable region comprises the CDR-H1, CDR-H2, CDR-H3 within SEQ ID NO: 895 and the light chain variable region comprises the CDR-L1, CDR-L2, CDR-L3 within SEQ ID NO: 969; 7) the heavy chain variable region comprises the CDR-H1, CDR-H2, CDR-H3 within SEQ ID NO: 896 and the light chain variable region comprises the CDR-L1, CDR-L2, CDR-L3 within SEQ ID NO: 970; 8) the heavy chain variable region comprises the CDR-H1, CDR-H2, CDR-H3 within SEQ ID NO: 897 and the light chain variable region comprises the CDR-L1, CDR-L2, CDR-L3 within SEQ ID NO: 971; 9) the heavy chain variable region comprises the CDR-H1, CDR-H2, CDR-H3 within SEQ ID NO: 898 and the light chain variable region comprises the CDR-L1, CDR-L2, CDR-L3 within SEQ ID NO: 972; 10) the heavy chain variable region comprises the CDR-H1, CDR-H2, CDR-H3 within SEQ ID NO: 899 and the light chain variable region comprises the CDR-L1, CDR-L2, CDR-L3 within SEQ ID NO: 973; 11) the heavy chain variable region comprises the CDR-H1, CDR-H2, CDR-H3 within SEQ ID NO: 900 and the light chain variable region comprises the CDR-L1, CDR-L2, CDR-L3 within SEQ ID NO: 974; 12) the heavy chain variable region comprises the CDR-H1, CDR-H2, CDR-H3 within SEQ ID NO: 901 and the light chain variable region comprises the CDR-L1, CDR-L2, CDR-L3 within SEQ ID NO: 975; 13) the heavy chain variable region comprises the CDR-H1, CDR-H2, CDR-H3 within SEQ ID NO: 902 and the light chain variable region comprises the CDR-L1, CDR-L2, CDR-L3 within SEQ ID NO: 976; 14) the heavy chain variable region comprises the CDR-H1, CDR-H2, CDR-H3 within SEQ ID NO: 903 and the light chain variable region comprises the CDR-L1, CDR-L2, CDR-L3 within SEQ ID NO: 977; 15) the heavy chain variable region comprises the CDR-H1, CDR-H2, CDR-H3 within SEQ ID NO: 904 and the light chain variable region comprises the CDR-L1, CDR-L2, CDR-L3 within SEQ ID NO: 978; 16) the heavy chain variable region comprises the CDR-H1, CDR-H2, CDR-H3 within SEQ ID NO: 905 and the light chain variable region comprises the CDR-L1, CDR-L2, CDR-L3 within SEQ ID NO: 979; 17) the heavy chain variable region comprises the CDR-H1, CDR-H2, CDR-H3 within SEQ ID NO: 906 and the light chain variable region comprises the CDR-L1, CDR-L2, CDR-L3 within SEQ ID NO: 980; 18) the heavy chain variable region comprises the CDR-H1, CDR-H2, CDR-H3 within SEQ ID NO: 907 and the light chain variable region comprises the CDR-L1, CDR-L2, CDR-L3 within SEQ ID NO: 981; 19) the heavy chain variable region comprises the CDR-H1, CDR-H2, CDR-H3 within SEQ ID NO: 908 and the light chain variable region comprises the CDR-L1, CDR-L2, CDR-L3 within SEQ ID NO: 982; 20) the heavy chain variable region comprises the CDR-H1, CDR-H2, CDR-H3 within SEQ ID NO: 909 and the light chain variable region comprises the CDR-L1, CDR-L2, CDR-L3 within SEQ ID NO: 983; 21) the heavy chain variable region comprises the CDR-H1, CDR-H2, CDR-H3 within SEQ ID NO: 910 and the light chain variable region comprises the CDR-L1, CDR-L2, CDR-L3 within SEQ ID NO: 984; 22) the heavy chain variable region comprises the CDR-H1, CDR-H2, CDR-H3 within SEQ ID NO: 911 and the light chain variable region comprises the CDR-L1, CDR-L2, CDR-L3 within SEQ ID NO: 985; 23) the heavy chain variable region comprises the CDR-H1, CDR-H2, CDR-H3 within SEQ ID NO: 912 and the light chain variable region comprises the CDR-L1, CDR-L2, CDR-L3 within SEQ ID NO: 986; 24) the heavy chain variable region comprises the CDR-H1, CDR-H2, CDR-H3 within SEQ ID NO: 913 and the light chain variable region comprises the CDR-L1, CDR-L2, CDR-L3 within SEQ ID NO: 987; 25) the heavy chain variable region comprises the CDR-H1, CDR-H2, CDR-H3 within SEQ ID NO: 914 and the light chain variable region comprises the CDR-L1, CDR-L2, CDR-L3 within SEQ ID NO: 988; 26) the heavy chain variable region comprises the CDR-H1, CDR-H2, CDR-H3 within SEQ ID NO: 915 and the light chain variable region comprises the CDR-L1, CDR-L2, CDR-L3 within SEQ ID NO: 989; 27) the heavy chain variable region comprises the CDR-H1, CDR-H2, CDR-H3 within SEQ ID NO: 916 and the light chain variable region comprises the CDR-L1, CDR-L2, CDR-L3 within SEQ ID NO: 990; 28) the heavy chain variable region comprises the CDR-H1, CDR-H2, CDR-H3 within SEQ ID NO: 917 and the light chain variable region comprises the CDR-L1, CDR-L2, CDR-L3 within SEQ ID NO: 991; 29) the heavy chain variable region comprises the CDR-H1, CDR-H2, CDR-H3 within SEQ ID NO: 918 and the light chain variable region comprises the CDR-L1, CDR-L2, CDR-L3 within SEQ ID NO: 992; 30) the heavy chain variable region comprises the CDR-H1, CDR-H2, CDR-H3 within SEQ ID NO: 919 and the light chain variable region comprises the CDR-L1, CDR-L2, CDR-L3 within SEQ ID NO: 993; 31) the heavy chain variable region comprises the CDR-H1, CDR-H2, CDR-H3 within SEQ ID NO: 920 and the light chain variable region comprises the CDR-L1, CDR-L2, CDR-L3 within SEQ ID NO: 994; 32) the heavy chain variable region comprises the CDR-H1, CDR-H2, CDR-H3 within SEQ ID NO: 921 and the light chain variable region comprises the CDR-L1, CDR-L2, CDR-L3 within SEQ ID NO: 995; 33) the heavy chain variable region comprises the CDR-H1, CDR-H2, CDR-H3 within SEQ ID NO: 922 and the light chain variable region comprises the CDR-L1, CDR-L2, CDR-L3 within SEQ ID NO: 996; 34) the heavy chain variable region comprises the CDR-H1, CDR-H2, CDR-H3 within SEQ ID NO: 923 and the light chain variable region comprises the CDR-L1, CDR-L2, CDR-L3 within SEQ ID NO: 997; 35) the heavy chain variable region comprises the CDR-H1, CDR-H2, CDR-H3 within SEQ ID NO: 924 and the light chain variable region comprises the CDR-L1, CDR-L2, CDR-L3 within SEQ ID NO: 998; 36) the heavy chain variable region comprises the CDR-H1, CDR-H2, CDR-H3 within SEQ ID NO: 925 and the light chain variable region comprises the CDR-L1, CDR-L2, CDR-L3 within SEQ ID NO: 999; 37) the heavy chain variable region comprises the CDR-H1, CDR-H2, CDR-H3 within SEQ ID NO: 926 and the light chain variable region comprises the CDR-L1, CDR-L2, CDR-L3 within SEQ ID NO: 1000; 38) the heavy chain variable region comprises the CDR-H1, CDR-H2, CDR-H3 within SEQ ID NO: 927 and the light chain variable region comprises the CDR-L1, CDR-L2, CDR-L3 within SEQ ID NO: 1001; 39) the heavy chain variable region comprises the CDR-H1, CDR-H2, CDR-H3 within SEQ ID NO: 928 and the light chain variable region comprises the CDR-L1, CDR-L2, CDR-L3 within SEQ ID NO: 1002; 40) the heavy chain variable region comprises the CDR-H1, CDR-H2, CDR-H3 within SEQ ID NO: 929 and the light chain variable region comprises the CDR-L1, CDR-L2, CDR-L3 within SEQ ID NO: 1003; 41) the heavy chain variable region comprises the CDR-H1, CDR-H2, CDR-H3 within SEQ ID NO: 930 and the light chain variable region comprises the CDR-L1, CDR-L2, CDR-L3 within SEQ ID NO: 1004; 42) the heavy chain variable region comprises the CDR-H1, CDR-H2, CDR-H3 within SEQ ID NO: 931 and the light chain variable region comprises the CDR-L1, CDR-L2, CDR-L3 within SEQ ID NO: 1005; 43) the heavy chain variable region comprises the CDR-H1, CDR-H2, CDR-H3 within SEQ ID NO: 932 and the light chain variable region comprises the CDR-L1, CDR-L2, CDR-L3 within SEQ ID NO: 1006; 44) the heavy chain variable region comprises the CDR-H1, CDR-H2, CDR-H3 within SEQ ID NO: 933 and the light chain variable region comprises the CDR-L1, CDR-L2, CDR-L3 within SEQ ID NO: 1007; 45) the heavy chain variable region comprises the CDR-H1, CDR-H2, CDR-H3 within SEQ ID NO: 934 and the light chain variable region comprises the CDR-L1, CDR-L2, CDR-L3 within SEQ ID NO: 1008; 46) the heavy chain variable region comprises the CDR-H1, CDR-H2, CDR-H3 within SEQ ID NO: 935 and the light chain variable region comprises the CDR-L1, CDR-L2, CDR-L3 within SEQ ID NO: 1009; 47) the heavy chain variable region comprises the CDR-H1, CDR-H2, CDR-H3 within SEQ ID NO: 936 and the light chain variable region comprises the CDR-L1, CDR-L2, CDR-L3 within SEQ ID NO: 1010; 48) the heavy chain variable region comprises the CDR-H1, CDR-H2, CDR-H3 within SEQ ID NO: 937 and the light chain variable region comprises the CDR-L1, CDR-L2, CDR-L3 within SEQ ID NO: 1011; 49) the heavy chain variable region comprises the CDR-H1, CDR-H2, CDR-H3 within SEQ ID NO: 938 and the light chain variable region comprises the CDR-L1, CDR-L2, CDR-L3 within SEQ ID NO: 1012; 50) the heavy chain variable region comprises the CDR-H1, CDR-H2, CDR-H3 within SEQ ID NO: 939 and the light chain variable region comprises the CDR-L1, CDR-L2, CDR-L3 within SEQ ID NO: 1013; 51) the heavy chain variable region comprises the CDR-H1, CDR-H2, CDR-H3 within SEQ ID NO: 940 and the light chain variable region comprises the CDR-L1, CDR-L2, CDR-L3 within SEQ ID NO: 1014; 52) the heavy chain variable region comprises the CDR-H1, CDR-H2, CDR-H3 within SEQ ID NO: 941 and the light chain variable region comprises the CDR-L1, CDR-L2, CDR-L3 within SEQ ID NO: 1015; 53) the heavy chain variable region comprises the CDR-H1, CDR-H2, CDR-H3 within SEQ ID NO: 942 and the light chain variable region comprises the CDR-L1, CDR-L2, CDR-L3 within SEQ ID NO: 1016; 54) the heavy chain variable region comprises the CDR-H1, CDR-H2, CDR-H3 within SEQ ID NO: 943 and the light chain variable region comprises the CDR-L1, CDR-L2, CDR-L3 within SEQ ID NO: 1017; 55) the heavy chain variable region comprises the CDR-H1, CDR-H2, CDR-H3 within SEQ ID NO: 944 and the light chain variable region comprises the CDR-L1, CDR-L2, CDR-L3 within SEQ ID NO: 1018; 56) the heavy chain variable region comprises the CDR-H1, CDR-H2, CDR-H3 within SEQ ID NO: 945 and the light chain variable region comprises the CDR-L1, CDR-L2, CDR-L3 within SEQ ID NO: 1019; 57) the heavy chain variable region comprises the CDR-H1, CDR-H2, CDR-H3 within SEQ ID NO: 946 and the light chain variable region comprises the CDR-L1, CDR-L2, CDR-L3 within SEQ ID NO: 1020; 58) the heavy chain variable region comprises the CDR-H1, CDR-H2, CDR-H3 within SEQ ID NO: 947 and the light chain variable region comprises the CDR-L1, CDR-L2, CDR-L3 within SEQ ID NO: 1021; 59) the heavy chain variable region comprises the CDR-H1, CDR-H2, CDR-H3 within SEQ ID NO: 948 and the light chain variable region comprises the CDR-L1, CDR-L2, CDR-L3 within SEQ ID NO: 1022; 60) the heavy chain variable region comprises the CDR-H1, CDR-H2, CDR-H3 within SEQ ID NO: 949 and the light chain variable region comprises the CDR-L1, CDR-L2, CDR-L3 within SEQ ID NO: 1023; 61) the heavy chain variable region comprises the CDR-H1, CDR-H2, CDR-H3 within SEQ ID NO: 950 and the light chain variable region comprises the CDR-L1, CDR-L2, CDR-L3 within SEQ ID NO: 1024; 62) the heavy chain variable region comprises the CDR-H1, CDR-H2, CDR-H3 within SEQ ID NO: 951 and the light chain variable region comprises the CDR-L1, CDR-L2, CDR-L3 within SEQ ID NO: 1025; 63) the heavy chain variable region comprises the CDR-H1, CDR-H2, CDR-H3 within SEQ ID NO: 952 and the light chain variable region comprises the CDR-L1, CDR-L2, CDR-L3 within SEQ ID NO: 1026; 64) the heavy chain variable region comprises the CDR-H1, CDR-H2, CDR-H3 within SEQ ID NO: 953 and the light chain variable region comprises the CDR-L1, CDR-L2, CDR-L3 within SEQ ID NO: 1027; 65) the heavy chain variable region comprises the CDR-H1, CDR-H2, CDR-H3 within SEQ ID NO: 954 and the light chain variable region comprises the CDR-L1, CDR-L2, CDR-L3 within SEQ ID NO: 1028; 66) the heavy chain variable region comprises the CDR-H1, CDR-H2, CDR-H3 within SEQ ID NO: 955 and the light chain variable region comprises the CDR-L1, CDR-L2, CDR-L3 within SEQ ID NO: 1029; 67) the heavy chain variable region comprises the CDR-H1, CDR-H2, CDR-H3 within SEQ ID NO: 956 and the light chain variable region comprises the CDR-L1, CDR-L2, CDR-L3 within SEQ ID NO: 1030; 68) the heavy chain variable region comprises the CDR-H1, CDR-H2, CDR-H3 within SEQ ID NO: 957 and the light chain variable region comprises the CDR-L1, CDR-L2, CDR-L3 within SEQ ID NO: 1031; 69) the heavy chain variable region comprises the CDR-H1, CDR-H2, CDR-H3 within SEQ ID NO: 958 and the light chain variable region comprises the CDR-L1, CDR-L2, CDR-L3 within SEQ ID NO: 1032; 70) the heavy chain variable region comprises the CDR-H1, CDR-H2, CDR-H3 within SEQ ID NO: 959 and the light chain variable region comprises the CDR-L1, CDR-L2, CDR-L3 within SEQ ID NO: 1033; 71) the heavy chain variable region comprises the CDR-H1, CDR-H2, CDR-H3 within SEQ ID NO: 960 and the light chain variable region comprises the CDR-L1, CDR-L2, CDR-L3 within SEQ ID NO: 1034; 72) the heavy chain variable region comprises the CDR-H1, CDR-H2, CDR-H3 within SEQ ID NO: 961 and the light chain variable region comprises the CDR-L1, CDR-L2, CDR-L3 within SEQ ID NO: 1035; 73) the heavy chain variable region comprises the CDR-H1, CDR-H2, CDR-H3 within SEQ ID NO: 962 and the light chain variable region comprises the CDR-L1, CDR-L2, CDR-L3 within SEQ ID NO: 1036; and/or 74) the heavy chain variable region comprises the CDR-H1, CDR-H2, CDR-H3 within SEQ ID NO: 963 and the light chain variable region comprises the CDR-L1, CDR-L2, CDR-L3 within SEQ ID NO: 1037.

In several embodiments, 1) the heavy chain variable region comprises SEQ ID NO: 890 and the light chain variable region comprises SEQ ID NO: 964; 2) the heavy chain variable region comprises SEQ ID NO: 891 and the light chain variable region comprises SEQ ID NO: 965; 3) the heavy chain variable region comprises SEQ ID NO: 892 and the light chain variable region comprises SEQ ID NO: 966; 4) the heavy chain variable region comprises SEQ ID NO: 893 and the light chain variable region comprises SEQ ID NO: 967; 5) the heavy chain variable region comprises SEQ ID NO: 894 and the light chain variable region comprises SEQ ID NO: 968; 6) the heavy chain variable region comprises SEQ ID NO: 895 and the light chain variable region comprises SEQ ID NO: 969; 7) the heavy chain variable region comprises SEQ ID NO: 896 and the light chain variable region comprises SEQ ID NO: 970; 8) the heavy chain variable region comprises SEQ ID NO: 897 and the light chain variable region comprises SEQ ID NO: 971; 9) the heavy chain variable region comprises SEQ ID NO: 898 and the light chain variable region comprises SEQ ID NO: 972; 10) the heavy chain variable region comprises SEQ ID NO: 899 and the light chain variable region comprises SEQ ID NO: 973; 11) the heavy chain variable region comprises SEQ ID NO: 900 and the light chain variable region comprises SEQ ID NO: 974; 12) the heavy chain variable region comprises SEQ ID NO: 901 and the light chain variable region comprises SEQ ID NO: 975; 13) the heavy chain variable region comprises SEQ ID NO: 902 and the light chain variable region comprises SEQ ID NO: 976; 14) the heavy chain variable region comprises SEQ ID NO: 903 and the light chain variable region comprises SEQ ID NO: 977; 15) the heavy chain variable region comprises SEQ ID NO: 904 and the light chain variable region comprises SEQ ID NO: 978; 16) the heavy chain variable region comprises SEQ ID NO: 905 and the light chain variable region comprises SEQ ID NO: 979; 17) the heavy chain variable region comprises SEQ ID NO: 906 and the light chain variable region comprises SEQ ID NO: 980; 18) the heavy chain variable region comprises SEQ ID NO: 907 and the light chain variable region comprises SEQ ID NO: 981; 19) the heavy chain variable region comprises SEQ ID NO: 908 and the light chain variable region comprises SEQ ID NO: 982; 20) the heavy chain variable region comprises SEQ ID NO: 909 and the light chain variable region comprises SEQ ID NO: 983; 21) the heavy chain variable region comprises SEQ ID NO: 910 and the light chain variable region comprises SEQ ID NO: 984; 22) the heavy chain variable region comprises SEQ ID NO: 911 and the light chain variable region comprises SEQ ID NO: 985; 23) the heavy chain variable region comprises SEQ ID NO: 912 and the light chain variable region comprises SEQ ID NO: 986; 24) the heavy chain variable region comprises SEQ ID NO: 913 and the light chain variable region comprises SEQ ID NO: 987; 25) the heavy chain variable region comprises SEQ ID NO: 914 and the light chain variable region comprises SEQ ID NO: 988; 26) the heavy chain variable region comprises SEQ ID NO: 915 and the light chain variable region comprises SEQ ID NO: 989; 27) the heavy chain variable region comprises SEQ ID NO: 916 and the light chain variable region comprises SEQ ID NO: 990; 28) the heavy chain variable region comprises SEQ ID NO: 917 and the light chain variable region comprises SEQ ID NO: 991; 29) the heavy chain variable region comprises SEQ ID NO: 918 and the light chain variable region comprises SEQ ID NO: 992; 30) the heavy chain variable region comprises SEQ ID NO: 919 and the light chain variable region comprises SEQ ID NO: 993; 31) the heavy chain variable region comprises SEQ ID NO: 920 and the light chain variable region comprises SEQ ID NO: 994; 32) the heavy chain variable region comprises SEQ ID NO: 921 and the light chain variable region comprises SEQ ID NO: 995; 33) the heavy chain variable region comprises SEQ ID NO: 922 and the light chain variable region comprises SEQ ID NO: 996; 34) the heavy chain variable region comprises SEQ ID NO: 923 and the light chain variable region comprises SEQ ID NO: 997; 35) the heavy chain variable region comprises SEQ ID NO: 924 and the light chain variable region comprises SEQ ID NO: 998; 36) the heavy chain variable region comprises SEQ ID NO: 925 and the light chain variable region comprises SEQ ID NO: 999; 37) the heavy chain variable region comprises SEQ ID NO: 926 and the light chain variable region comprises SEQ ID NO: 1000; 38) the heavy chain variable region comprises SEQ ID NO: 927 and the light chain variable region comprises SEQ ID NO: 1001; 39) the heavy chain variable region comprises SEQ ID NO: 928 and the light chain variable region comprises SEQ ID NO: 1002; 40) the heavy chain variable region comprises SEQ ID NO: 929 and the light chain variable region comprises SEQ ID NO: 1003; 41) the heavy chain variable region comprises SEQ ID NO: 930 and the light chain variable region comprises SEQ ID NO: 1004; 42) the heavy chain variable region comprises SEQ ID NO: 931 and the light chain variable region comprises SEQ ID NO: 1005; 43) the heavy chain variable region comprises SEQ ID NO: 932 and the light chain variable region comprises SEQ ID NO: 1006; 44) the heavy chain variable region comprises SEQ ID NO: 933 and the light chain variable region comprises SEQ ID NO: 1007; 45) the heavy chain variable region comprises SEQ ID NO: 934 and the light chain variable region comprises SEQ ID NO: 1008; 46) the heavy chain variable region comprises SEQ ID NO: 935 and the light chain variable region comprises SEQ ID NO: 1009; 47) the heavy chain variable region comprises SEQ ID NO: 936 and the light chain variable region comprises SEQ ID NO: 1010; 48) the heavy chain variable region comprises SEQ ID NO: 937 and the light chain variable region comprises SEQ ID NO: 1011; 49) the heavy chain variable region comprises SEQ ID NO: 938 and the light chain variable region comprises SEQ ID NO: 1012; 50) the heavy chain variable region comprises SEQ ID NO: 939 and the light chain variable region comprises SEQ ID NO: 1013; 51) the heavy chain variable region comprises SEQ ID NO: 940 and the light chain variable region comprises SEQ ID NO: 1014; 52) the heavy chain variable region comprises SEQ ID NO: 941 and the light chain variable region comprises SEQ ID NO: 1015; 53) the heavy chain variable region comprises SEQ ID NO: 942 and the light chain variable region comprises SEQ ID NO: 1016; 54) the heavy chain variable region comprises SEQ ID NO: 943 and the light chain variable region comprises SEQ ID NO: 1017; 55) the heavy chain variable region comprises SEQ ID NO: 944 and the light chain variable region comprises SEQ ID NO: 1018; 56) the heavy chain variable region comprises SEQ ID NO: 945 and the light chain variable region comprises SEQ ID NO: 1019; 57) the heavy chain variable region comprises SEQ ID NO: 946 and the light chain variable region comprises SEQ ID NO: 1020; 58) the heavy chain variable region comprises SEQ ID NO: 947 and the light chain variable region comprises SEQ ID NO: 1021; 59) the heavy chain variable region comprises SEQ ID NO: 948 and the light chain variable region comprises SEQ ID NO: 1022; 60) the heavy chain variable region comprises SEQ ID NO: 949 and the light chain variable region comprises SEQ ID NO: 1023; 61) the heavy chain variable region comprises SEQ ID NO: 950 and the light chain variable region comprises SEQ ID NO: 1024; 62) the heavy chain variable region comprises SEQ ID NO: 951 and the light chain variable region comprises SEQ ID NO: 1025; 63) the heavy chain variable region comprises SEQ ID NO: 952 and the light chain variable region comprises SEQ ID NO: 1026; 64) the heavy chain variable region comprises SEQ ID NO: 953 and the light chain variable region comprises SEQ ID NO: 1027; 65) the heavy chain variable region comprises SEQ ID NO: 954 and the light chain variable region comprises SEQ ID NO: 1028; 66) the heavy chain variable region comprises SEQ ID NO: 955 and the light chain variable region comprises SEQ ID NO: 1029; 67) the heavy chain variable region comprises SEQ ID NO: 956 and the light chain variable region comprises SEQ ID NO: 1030; 68) the heavy chain variable region comprises SEQ ID NO: 957 and the light chain variable region comprises SEQ ID NO: 1031; 69) the heavy chain variable region comprises SEQ ID NO: 958 and the light chain variable region comprises SEQ ID NO: 1032; 70) the heavy chain variable region comprises SEQ ID NO: 959 and the light chain variable region comprises SEQ ID NO: 1033; 71) the heavy chain variable region comprises SEQ ID NO: 960 and the light chain variable region comprises SEQ ID NO: 1034; 72) the heavy chain variable region comprises SEQ ID NO: 961 and the light chain variable region comprises SEQ ID NO: 1035; 73) the heavy chain variable region comprises SEQ ID NO: 962 and the light chain variable region comprises SEQ ID NO: 1036; and/or 74) the heavy chain variable region comprises SEQ ID NO: 963 and the light chain variable region comprises SEQ ID NO: 1037.

In several embodiments, the heavy chain variable region further comprises a FW-H1, FW-H2, FW-H3, and FW-H4, and the light chain variable region further comprises a FW-L1, FW-L2, FW-L3, and FW-L4, and wherein: the FW-H1 comprises a sequence having at least 90%, 95%, 99%, or 100% sequence identity to a sequence selected from SEQ ID NOs: 399-402; the FW-H2 comprises a sequence having at least 90%, 95%, 99%, or 100% sequence identity to a sequence selected from SEQ ID NOs: 403-406; the FW-H3 comprises a sequence having at least 90%, 95%, 99%, or 100% sequence identity to a sequence selected from SEQ ID NOs: 407-422; the FW-H4 comprises a sequence having at least 90%, 95%, 99%, or 100% sequence identity to a sequence selected from SEQ ID NOs: 423-427; the FW-L1 comprises a sequence having at least 90%, 95%, 99%, or 100% sequence identity to a sequence selected from SEQ ID NOs: 650-653; the FW-L2 comprises a sequence having at least 90%, 95%, 99%, or 100% sequence identity to a sequence selected from SEQ ID NOs: 654-657; the FW-L3 comprises a sequence having at least 90%, 95%, 99%, or 100% sequence identity to a sequence selected from SEQ ID NOs: 658-661; and/or the FW-L4 comprises a sequence having at least 90%, 95%, 99%, or 100% sequence identity to a sequence selected from SEQ ID NOs: 662-667. In several embodiments, the heavy chain variable domain is encoded by a nucleic acid sequence having at least 90%, 95%, 99%, or 100% sequence identity to any sequence selected from SEQ ID NOs: 1038-1111. In several embodiments, the light chain variable domain is encoded by a nucleic acid sequence having at least 90%, 95%, 99%, or 100% sequence identity to any sequence selected from SEQ ID NOs: 1112-1185. In several embodiments, the anti-CD70 binding domain is an antibody, Fab' fragment, F(ab')2 fragment, or scFv. In several embodiments, one or more of the anti-CD70 binding domains as disclosed above is incorporated into a CAR. In several embodiments, such a CAR further comprises an OX40 subdomain and a CD3zeta subdomain (or any signaling/co-stimulatory domain disclosed herein). In several embodiments, the CAR consists of or consists essentially of a CD70 binding domain as disclosed herein, a transmembrane domain/hinge, an OX40 domain and a CD3zeta domain. In several embodiments, the OX40 subdomain comprises an amino sequence having at least 90%, 95%, 99%, or 100% sequence identity to SEQ ID NO: 6. In several embodiments, the OX40 subdomain is encoded by a sequence having at least 90%, 95%, 99%, or 100% sequence identity to SEQ ID NO: 5. In several embodiments, the CD3zeta subdomain comprises an amino sequence having at least 90%, 95%, 99%, or 100%, sequence identity to SEQ ID NO: 8. In several embodiments, the CD3zeta subdomain is encoded by a sequence having at least 90%, 95%, 99%, or 100% sequence identity to SEQ ID NO: 7. In several embodiments, the CAR comprises at least two anti-CD70 binding domains and the CAR is a multivalent CAR. In several embodiments, the multivalent CAR comprises at least two anti-CD70 binding domains and the CAR is a bivalent CAR. In several embodiments, the bivalent CAR comprises a first anti-CD70 binding domain and a second anti-CD70 binding domain, wherein the first anti-CD70 binding domain and second anti-CD70 binding domain each comprise: a) a heavy chain variable region comprising the sequence of SEQ ID NO: 923 and a light chain variable region comprising the sequence of SEQ ID NO: 997; b) a heavy chain variable region comprising the sequence of SEQ ID NO: 949 and a light chain variable region comprising the sequence of SEQ ID NO: 1023; c) a heavy chain variable region comprising the sequence of SEQ ID NO: 950 and a light chain variable region comprising the sequence of SEQ ID NO: 1024; d) a heavy chain variable region comprising the sequence of SEQ ID NO: 952 and a light chain variable region comprising the sequence of SEQ ID NO: 1026; and/or e) a heavy chain variable region comprising the sequence of SEQ ID NO: 953 and a light chain variable region comprising the sequence of SEQ ID NO: 1027. In several embodiments, there is provided a cell comprising an anti-CD70 binding domain and/or a CAR as disclosed above. In several embodiments, another CAR is engineered into the cell. In several embodiments, that CAR does not target NKG2D ligands. In several embodiments, that CAR does not target CD19. In several embodiments, the cell is an immune cell. In several embodiments, the cell is an NK cell. In several embodiments, the cell is used in combination with another cell type (such as, for example, an engineered T cell). In several embodiments, immune cell is not a T cell, a gamma T cell or a delta gamma T cell. In several embodiments, the cell is genetically edited to express a reduced level of CISH, an adenosine receptor, A2A adenosine receptor, A2B adenosine receptor, A3 adenosine receptor, A1 adenosine receptor, A2AR, TGFBR, B2M, CIITA, NKG2A, CBLB, TRIM29, SOCS2, SMAD3, MAPKAPK3, CEACAM1, or DDIT4, or any combination thereof, as compared to a non-engineered cell. In several embodiments, the cell is genetically edited with one or more guide RNAs having at least 90% or at least 95% sequence identity to SEQ ID NOs: 1190-1201. In several embodiments, the NK cells are genetically edited to express a reduced level of SMAD3, MAPKAPK3, CEACAM1, or DDIT4, or any combination thereof, as compared to a non-engineered NK cell. In several embodiments, the NK cells are genetically edited with one or more guide RNAs having at least 90% or at least 95% sequence identity to SEQ ID NOs: 1190-1201. In several embodiments, selected genes may not be disrupted in the engineered cells. For example, in one embodiment, the immune cells have not undergone disruption of a T Cell Receptor Alpha Constant (TRAC) gene. In one embodiment, the immune cells have not undergone disruption of a B2M gene. In one embodiment, the immune cells have not undergone disruption of MHC Class I.

In several embodiments, there is provided a method of treating cancer in a subject comprising administering to the subject one or more anti-CD70 binding domain as described above (or elsewhere herein). In several embodiments, there is provided a use of the anti-CD70 binding domain as described above (or elsewhere herein) for the treatment of cancer and/or in the manufacture of a medicament for the treatment of cancer.

In several embodiments, the NK cells disclosed herein are engineered to express interleukin 15 (IL15, IL-15). In some embodiments, the IL15 is a membrane-bound IL15 (mbIL15). In some embodiments, the mbIL15 comprises a native IL15 sequence and at least one transmembrane domain. In some embodiments, the native IL15 sequence is a human native IL15 sequence. In some embodiments, the native IL15 sequence is encoded by a sequence having at least 85%, at least 90%, at least 95% sequence identity to SEQ ID NO: 11. In some embodiments, the native IL15 sequence comprises a peptide sequence having at least 85%, at least 90%, at least 95% sequence identity to SEQ ID NO: 12. In several embodiments, the mbIL15 is encoded by a sequence having at least 85%, at least 90%, at least 95% sequence identity to SEQ ID NO: 1188. In some embodiments, the mbIL15 comprises a peptide sequence having at least 85%, at least 90%, at least 95% sequence identity to SEQ ID NO: 1189. In some embodiments, the mbIL15 is optionally bicistronically encoded on the polynucleotide encoding the CAR. In several embodiments, the CAR is encoded by a polynucleotide having at least 85%, at least 90%, or at least 95% sequence identity to one or more of the polynucleotides of SEQ ID NO: 138-220 or a portion thereof (e.g. a portion excluding the mbIL15 sequence and/or self-cleaving peptide sequence), and/or comprises an amino acid sequence having at least 85%, at least 90%, or at least 95% sequence identity to one or more of the amino acid sequences of SEQ ID NO: 313-395, or a portion thereof (e.g. a portion excluding the mbIL15 sequence and/or self-cleaving peptide sequence).

In several embodiments, expression of CIS is substantially reduced as compared to a non-engineered NK cell. In several embodiments, the NK cells do not express a detectable level of CIS protein.

In several embodiments, the NK cells are further genetically engineered to express a reduced level of a transforming growth factor beta receptor (TGFBR) as compared to a non-engineered NK cell, to express a reduced level of beta-2 microglobulin (B2M) as compared to a non-engineered NK cell, to express a reduced level of CIITA (class II major histocompatibility complex transactivator) as compared to a non-engineered NK cell, to express a reduced level of a Natural Killer Group 2, member A (NKG2A) receptor as compared to a non-engineered NK cell, to express a reduced level of a Cbl proto-oncogene B protein encoded by a CBLB gene as compared to a non-engineered NK cell, to express a reduced level of a tripartite motif-containing protein 29 protein encoded by a TRIM29 gene as compared to a non-engineered NK cell, to express a reduced level of a suppressor of cytokine signaling 2 protein encoded by a SOCS2 gene as compared to a non-engineered NK cell, to express a reduced level of a mothers against decapentaplegic homolog 3 (SMAD3) protein encoded by a SMAD3 gene as compared to a non-engineered NK cell, to express a reduced level of a MAP kinase-activated protein kinase 3 (MAPKAPK3) protein encoded by a MAPKAPK3 gene as compared to a non-engineered NK cell, to express a reduced level of a carcinoembryonic antigen-related cell adhesion molecule 1 (CEACAM1) protein encoded by a CEACAM1 gene as compared to a non-engineered NK cell, to express a reduced level of a DNA-damage-inducible transcript 4 (DDIT4) protein encoded by a DDIT4 gene as compared to a non-engineered NK cell, to express CD47, and/or to express HLA-E, or any combination thereof. In several embodiments, the NK cells are further genetically edited to disrupt expression of at least one immune checkpoint protein by the NK cells. In several embodiments, the at least one immune checkpoint protein is selected from CTLA4, PD-1, lymphocyte activation gene (LAG-3), NKG2A receptor, KIR2DL-1, KIR2DL-2, KIR2DL-3, KIR2DS-1 and/or KIR2DA-2, and combinations thereof.

According to several embodiments, the gene editing to reduce expression or the gene editing to induce expression is made using a CRISPR-Cas system. In several embodiments, the CRISPR-Cas system comprises a Cas selected from Cas9, Csn2, Cas4, Cpf1, C2c1, C2c3, Cas13a, Cas13b, Cas13c, CasX, CasY, and combinations thereof. In several embodiments, the Cas is Cas9.

According to several embodiments, the CRISPR-Cas system comprises a Cas selected from Cas3, Cas8a, Cas5, Cas8b, Cas8c, Cas10d, Cse1, Cse2, Csy1, Csy2, Csy3, GSU0054, Cas10, Csm2, Cmr5, Cas10, Csx11, Csx10, Csf1, and combinations thereof. In several embodiments, the one or more guide RNA having at least 95% sequence identity to SEQ ID NO: 121, SEQ ID NO: 122, or SEQ ID NO: 123 is used to edit the CD70 gene. In several embodiments, the one or more guide RNA having at least 85%, 90%, or 95% sequence identity to SEQ ID NO: 130, SEQ ID NO: 131, SEQ ID NO: 132, SEQ ID NO: 133, or SEQ ID NO: 134 is used to edit the CISH gene. In several embodiments, one or more guide RNA having at least 85%, 90%, or 95% sequence identity to SEQ ID NO: 130, SEQ ID NO: 131, SEQ ID NO: 132, SEQ ID NO: 133, or SEQ ID NO: 134 is used to edit the TGFBR2 gene.

In several embodiments, the gene editing to reduce expression or the gene editing to induce expression is made using a zinc finger nuclease (ZFN). In several embodiments, the gene editing to reduce expression or the gene editing to induce expression is made using a Transcription activator-like effector nuclease (TALEN).

Depending on the method, the cancer to be treated is renal cell carcinoma, or a metastasis from renal cell carcinoma.

In several embodiments, the methods disclosed herein further comprising optionally administering a plurality of engineered T cells, wherein the T cells are engineered to express a CAR. In several embodiments, the CAR expressed by the T cells is directed to CD70.

In several embodiments, there is provided a polynucleotide encoding an anti-CD70 chimeric antigen receptor, wherein the CAR comprises an anti-CD70 binding domain, wherein the anti-CD70 binding domain is encoded by a polynucleotide comprising a sequence having at least 95% sequence identity to one or more of SEQ ID NOs: 38-120, 221-229, 1038-1111, 1112-1185, and/or comprises an amino acid sequence having at least 95% sequence identity to one or more of the amino acid sequences of SEQ ID NO: 230-312, 890-963, 964-1037. In several embodiments, the CAR comprises an OX40 subdomain encoded by a sequence having at least 85%, 90%, or 95% sequence identity to SEQ ID NO: 5. In several embodiments, the OX40 subdomain comprises an amino acid sequence having at least 85%, at least 90%, or at least 95% sequence identity to SEQ ID NO: 6. In several embodiments, the CAR comprises a CD3zeta domain encoded by a sequence having at least 85%, 90%, or 95% sequence identity to SEQ ID NO: 7. In several embodiments, the CD3zeta subdomain comprises an amino acid sequence having at least 85%, at least 90%, or at least 95% sequence identity to SEQ ID NO: 8. In several embodiments, there is further provided a polynucleotide encoding mbIL15, wherein the mbIL15 is encoded by a sequence having at least 85%, 90%, or 95% sequence identity to SEQ ID NO: 1188. In several embodiments, the mbIL15 comprises an amino acid sequence having at least 85%, at least 90%, or at least 95% sequence identity to SEQ ID NO: 1189. In several embodiments, the one or more of SEQ ID NOs: 38-120, 221-229, 1038-1111, 1112-1185, the polynucleotide encoding OX40, the polynucleotide encoding CD3zeta, and the polynucleotide encoding mbIL15 are arranged in a 5' to 3' orientation within the polynucleotide.

Also provided for herein is a method of enhancing the persistence of a population of immune cells to be used in cancer immunotherapy, comprising identifying a target marker on a tumor to be treated, determining if a population of immune cells to be engineered to express a CAR that binds the target marker also endogenously expresses the target marker; editing the genome of the population of immune cells to disrupt the gene encoding the endogenous target marker, and engineering the population of immune cells to express the CAR, wherein the disruption of the endogenous expression of the target marker by the immune cells reduces the ability of the CAR to bind the endogenous target marker on the immune cells, thereby enhancing the persistence of the population of immune cells.

In several embodiments, the immune cells are NK cells, T cells, or a combination thereof. In several embodiments, the target marker is CD70. In several embodiments, the gene editing is made using a CRISPR-Cas system and the Cas is optionally guided to the endogenous gene by one or more of SEQ ID NOs: 121-123. In several embodiments, a CRISPR-Cas system to disrupt expression of a cytokine-inducible SH2-containing (CIS) protein encoded by a CISH gene. In several embodiments, the Cas is guided to the endogenous gene by one or more of SEQ ID NOs: 130-134. In several embodiments, an adenosine receptor, such as the A2AR is edited. In several embodiments, a CRISPR-Cas system is used to edit a gene encoding an adenosine receptor. In several embodiments, the Cas is guided to the endogenous gene by one or more of SEQ ID NOs: 396-398. In several embodiments, SMAD3 is edited. In several embodiments, a CRISPR-Cas system is used to edit a gene encoding SMAD3. In several embodiments, the Cas is guided to the endogenous gene by one or more of SEQ ID NOs: 1190-1192. In several embodiments, MAPKAPK3 is edited. In several embodiments, a CRISPR-Cas system is used to edit a gene encoding MAPKAPK3. In several embodiments, the Cas is guided to the endogenous gene by one or more of SEQ ID NOs: 1193-1195. In several embodiments, CEACAM1 is edited. In several embodiments, a CRISPR-Cas system is used to edit a gene encoding CEACAM1. In several embodiments, the Cas is guided to the endogenous gene by one or more of SEQ ID NOs: 1196-1198. In several embodiments, DDIT4 is edited. In several embodiments, a CRISPR-Cas system is used to edit a gene encoding DDIT4. In several embodiments, the Cas is guided to the endogenous gene by one or more of SEQ ID NOs: 1199-1201. In several embodiments, combinations of one or more of the above genes are edited (optionally in combination with other genes to be edited as disclosed elsewhere herein).

Provided for herein, in several embodiments, is an anti-CD70 chimeric antigen receptor (CAR), wherein the CAR comprises an anti-CD70 binding domain, an OX40 domain, and a CD3zeta domain, wherein the anti-CD70 CAR is encoded by a polynucleotide having at least 80%, 85%, 90%, or 95% sequence identity to one or more of SEQ ID NOS: 138-220, wherein SEQ ID NOS: 138-220 also bicistronically encode mbIL15.

Provided for herein, in several embodiments, is an anti-CD70 chimeric antigen receptor (CAR), wherein the CAR comprises an anti-CD70 binding domain, an OX40 domain, and a CD3zeta domain, wherein the anti-CD70 CAR comprises an amino acid sequence having at least 80%, 85%, 90%, or 95% sequence identity to one or more of the amino acid sequences of SEQ ID NO: 313-395, or a portion thereof (e.g. a portion excluding the mbIL15 sequence and/or self-cleaving peptide sequence).

Some embodiments relate to a method comprising administering an immune cell as described herein to a subject in need. In some embodiments, the subject has cancer. In some embodiments, the administration treats, inhibits, or prevents progression of the cancer.

Several embodiments provide for uses of the cells, anti-CD70 scFvs, anti-CD70 CARs, and/or the polynucleotides or amino acid sequences disclosed herein in the treatment or prevention of cancer. Several embodiments provide for uses of the cells, anti-CD70 scFvs, anti-CD70 CARs, and/or the polynucleotides or amino acid sequences disclosed herein in the manufacture of a medicament for treatment or prevention of cancer.

BRIEF DESCRIPTION OF THE DRAWINGS

FIGS. 11A-11D show flow cytometry data related to CRISPR-mediated knockdown of CD70. FIG. 11A shows data for CD70 expression on NK cells from a first donor after CRISPR-mediated knockdown using three different guide RNAs. FIG. 11B shows corresponding control data for the first donor. FIG. 11C shows data for CD70 expression on NK cells from a second donor after CRISPR-mediated knockdown using three different guide RNAs. FIG. 11D shows corresponding control data for the first donor. These experiments were performed using the KD7 protocol.

FIG. 12A shows expression of CD70 using guide RNA 1. FIG. 12B shows expression of CD70 using guide RNA 2. FIG. 12C shows expression of CD70 using guide RNA 3. FIG. 12D shows expression of CD70 by non-electroporated NK cells. FIG. 12E shows unstained NK cells. These experiments were performed using the KD7 protocol.

FIG. 13A shows expression of CD70 using guide RNA 1+2. FIG. 13B shows expression of CD70 using guide RNA 1+3. FIG. 13C shows expression of CD70 using guide RNA 2+3. FIGS. 13D and 13E are the same controls as shown in FIGS. 12D and 12E. These experiments were performed using the KD7 protocol.

FIG. 14A shows expression of CD70 using guide RNA 1. FIG. 14B shows expression of CD70 using guide RNA 2. FIG. 14C shows expression of CD70 using guide RNA 3. FIG. 14D shows expression of CD70 by non-electroporated NK cells. FIG. 14E shows unstained NK cells. These experiments were performed using the KD7 protocol, with the cells being cultured from Day 11 to Day 21 in low IL-2 media. FIG. 14F shows an additional non-limiting gene editing process.

FIG. 15A shows expression of CD70 using guide RNA 1+2. FIG. 15B shows expression of CD70 using guide RNA 1+3. FIG. 15C shows expression of CD70 using guide RNA 2+3. FIGS. 15D and 15E are the same controls as shown in FIGS. 14D and 14E. These experiments were performed using the KD7 protocol, with the cells being cultured from Day 11 to Day 21 in low IL-2 media.

FIG. 16A shows data from a first donor with each of three guide RNAs used singly. FIG. 16B shows CD70 expression using the same individual guide RNAs, but with NK cells from a different donor. FIG. 16C shows control data (donor 2).

FIGS. 17A-17C show flow cytometry data related to knockdown of CD70 expression in the same two donors as FIG. 16, with expression evaluated after 8 days (day 13 of the KD0 protocol). FIG. 17A shows data from a first donor with each of three guide RNAs used singly. FIG. 17B shows CD70 expression using the same individual guide RNAs, but with NK cells from a different donor. FIG. 17C shows control data (donor 2).

FIG. 18A shows CD70-KO-NK cell (generated using individual guide RNA 1, 2, or 3 on NK cells from a first donor) cytotoxicity against REH cells, which do not express CD27, which is the ligand for CD70, at the indicated effector:target ratios. FIG. 18B shows the cytotoxicity of CD70-KO-NK cells from donor 1 against Jurkat cells, which do express CD27. FIG. 18C shows CD70-KO-NK cell (NK cells from a second donor) cytotoxicity against REH cells. FIG. 18D shows the cytotoxicity of CD70-KO-NK cells from donor 2 against Jurkat cells. Cytotoxicity was assessed at Day 14.

FIG. 20A shows CD70 expression by NK cells using three different guide RNAs. FIG. 20B shows CD70 expression by NK cells from a second donor and edited using the same guide RNAs. FIG. 20C shows related control data.

FIG. 21A shows CD70 expression by Jurkat cells from a first donor after editing with three different combinations of guide RNA. FIG. 21B shows control data.

FIG. 22A shows a sample protocol. FIG. 22B shows CD70 expression by the Jurkat cells after CRISPR editing using three different guide RNA sets, with the cells being kept in culture after the gene editing.

FIG. 22C shows CD70 expression by the Jurkat cells after CRISPR editing using the same guide RNA sets, but with the cells being frozen after the gene editing and then thawed for flow analysis. FIG. 23D shows control data.

FIG. 24A shows data related to CD70 and GFP expression on native Jurkat cells. The right panel of FIG. 24A indicates that native Jurkat cells express relatively low levels of CD70. FIG. 24B shows expression of CD70 in Jurkat cells engineered to express the marker at elevated (e.g., for purposes of tonic signaling and CD70 CAR screening). As seen in the right panel of FIG. 24B CD70 expression is significantly increased on these Jurkat cells (~85% of the cells are positive for human CD70 and GFP (used as a marker for transduced cells). FIG. 24C shows the reduction of Jurkat native CD70 expression through the use of a first guide RNA and CRISPR gene editing. FIG. 24D shows that the engineered constitutive expression of CD70 on Jurkat cells is maintained even in the face of CRISPR gene editing to reduce CD70. FIG. 24E and FIG. 24F show similar data regarding the maintenance of expression of CD70 on the engineered Jurkat cells.

FIG. 25 shows a table summarizing CD70 expression data (MFI) for the various conditions shown in FIG. 24A-24F.

The data indicate that the engineered CD70-expressing Jurkat cells exhibit near constitutive expression of CD70, even higher than a known high-expressing cell line, the 786-O cells.

Figure 26A:
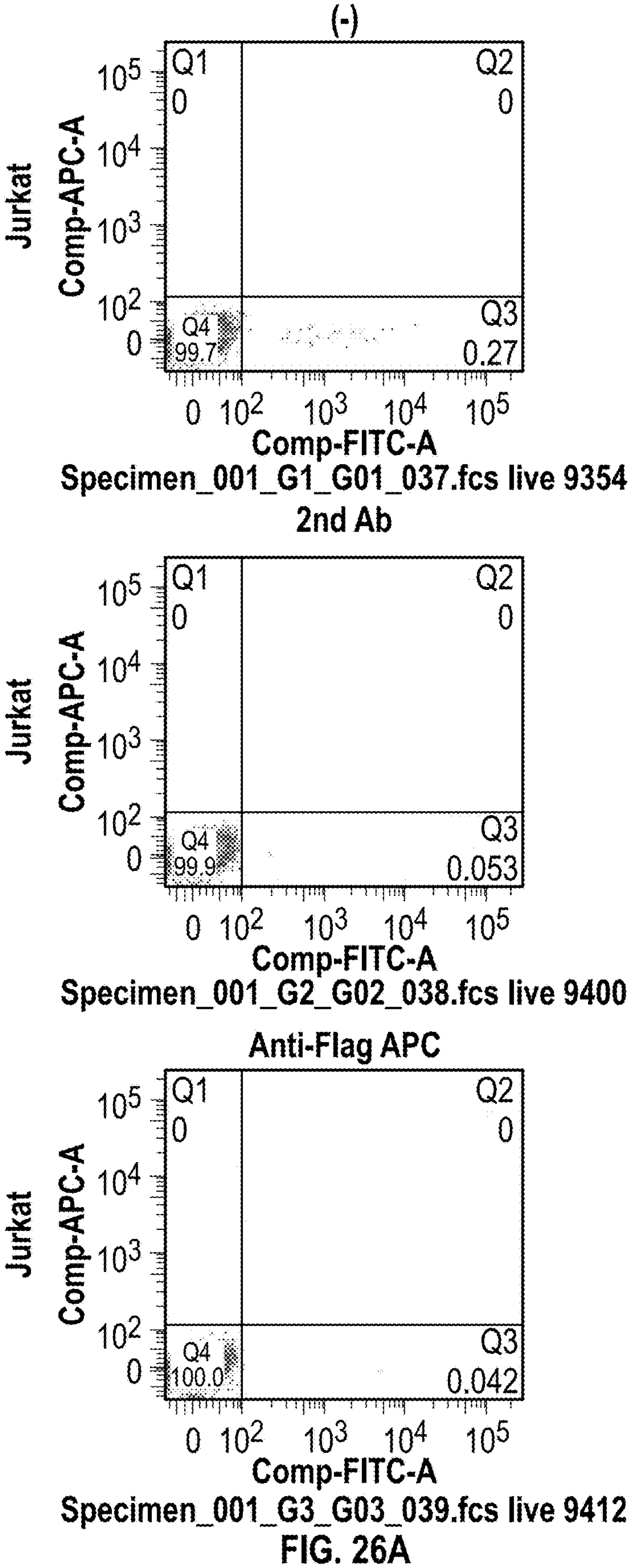
Figure 26B:
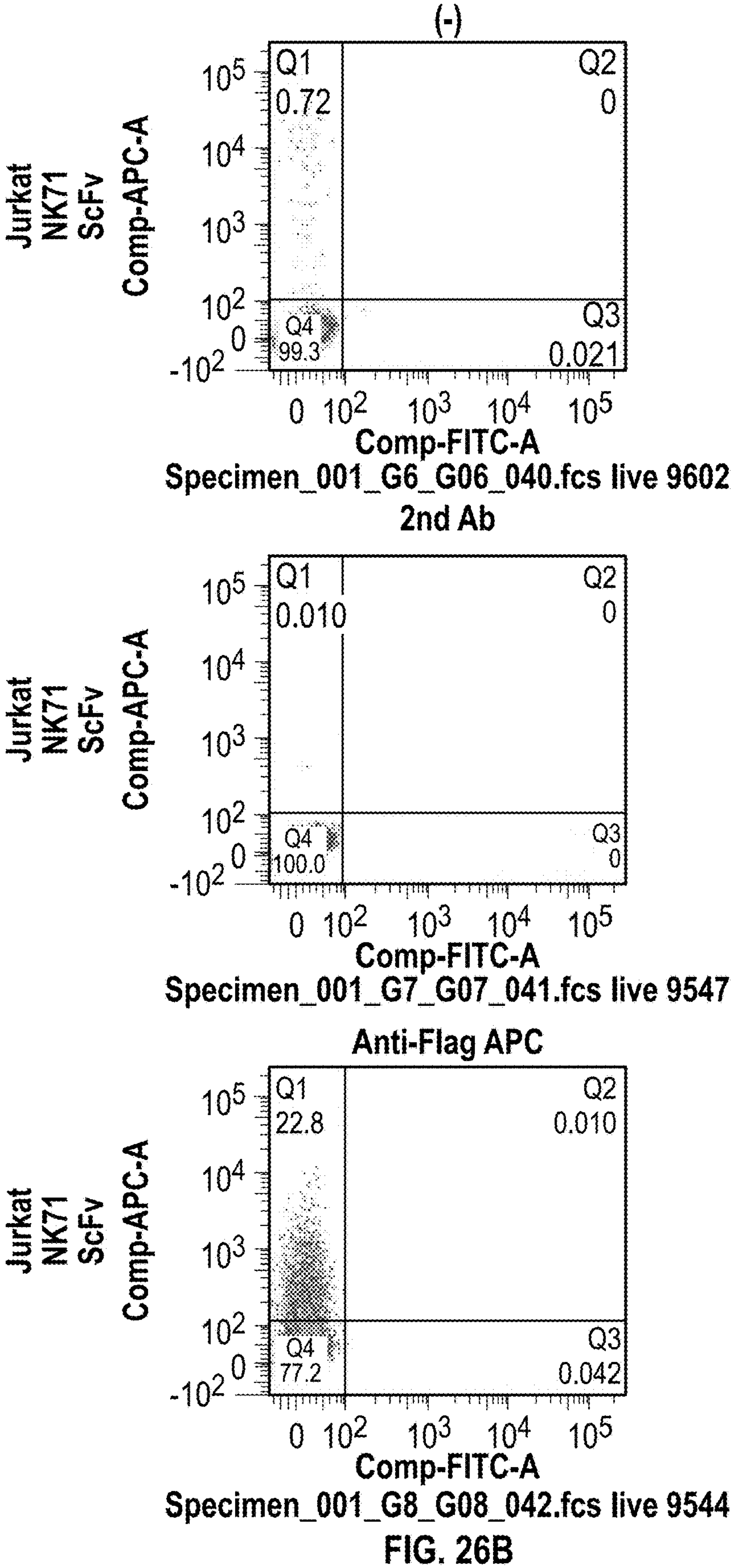
Figure 26C:
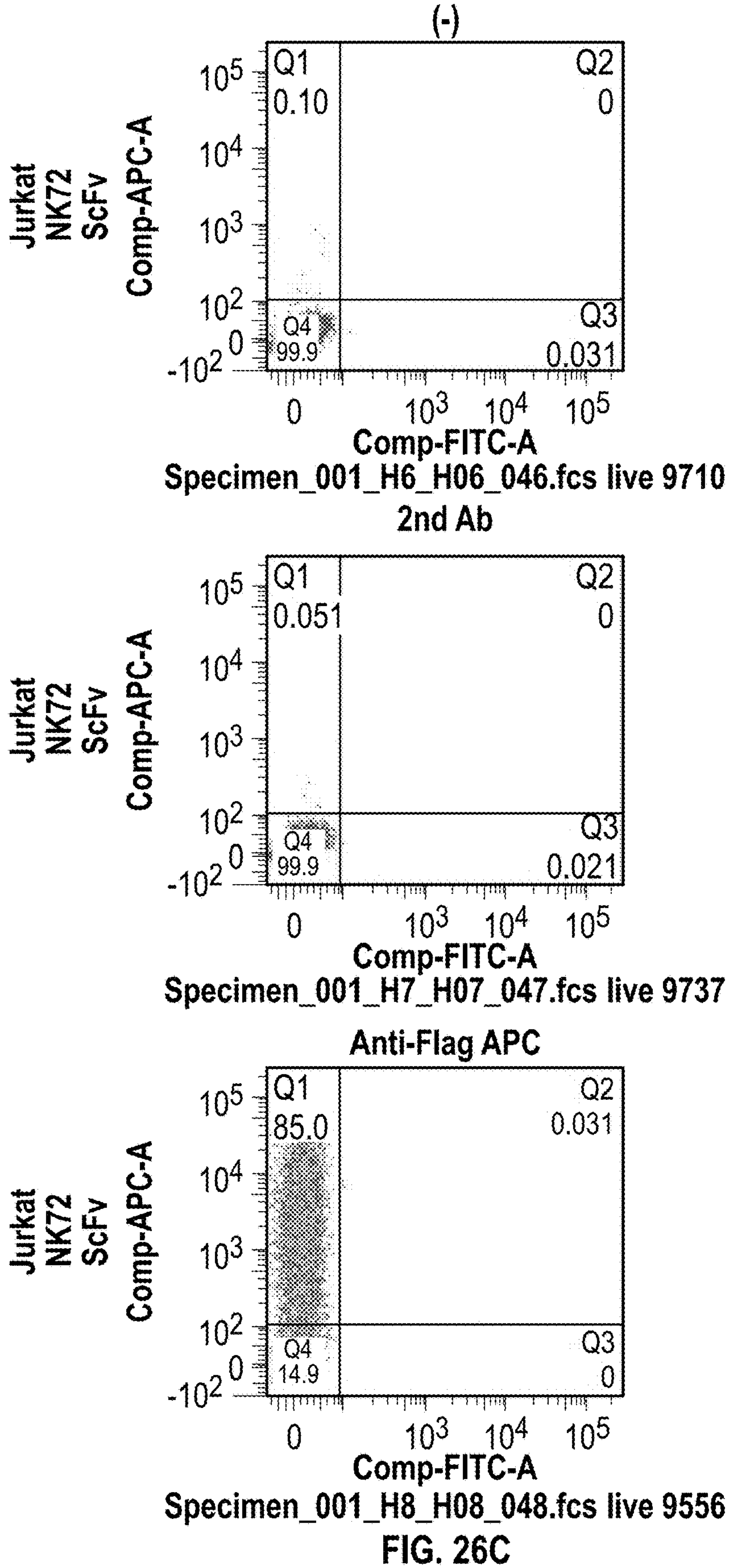

FIGS. 26A-26C relate to expression of anti-CD70 CAR constructs on Jurkat cells. As non-limiting examples of anti-CD70 CAR, Jurkat cells were transduced with NK71 or NK72 constructs (schematically depicted in FIG. 6). The left panels in FIGS. 26A-26C is a negative control, the central panel is the control for the secondary antibody and the right panel shows data related to signal detected with an anti-Flag antibody. FIG. 26A shows control data related to detecting Flag expression on Jurkat cells. The Flag tag is used in some embodiments to detect expression of a CAR construct. In several embodiments, the Flag tag is not included. FIG. 26B shows expression of the NK71 anti-CD70 CAR construct and FIG. 26C shows expression of the NK72 anti-CD70 CAR construct by Jurkat cells.

Figure 27A:
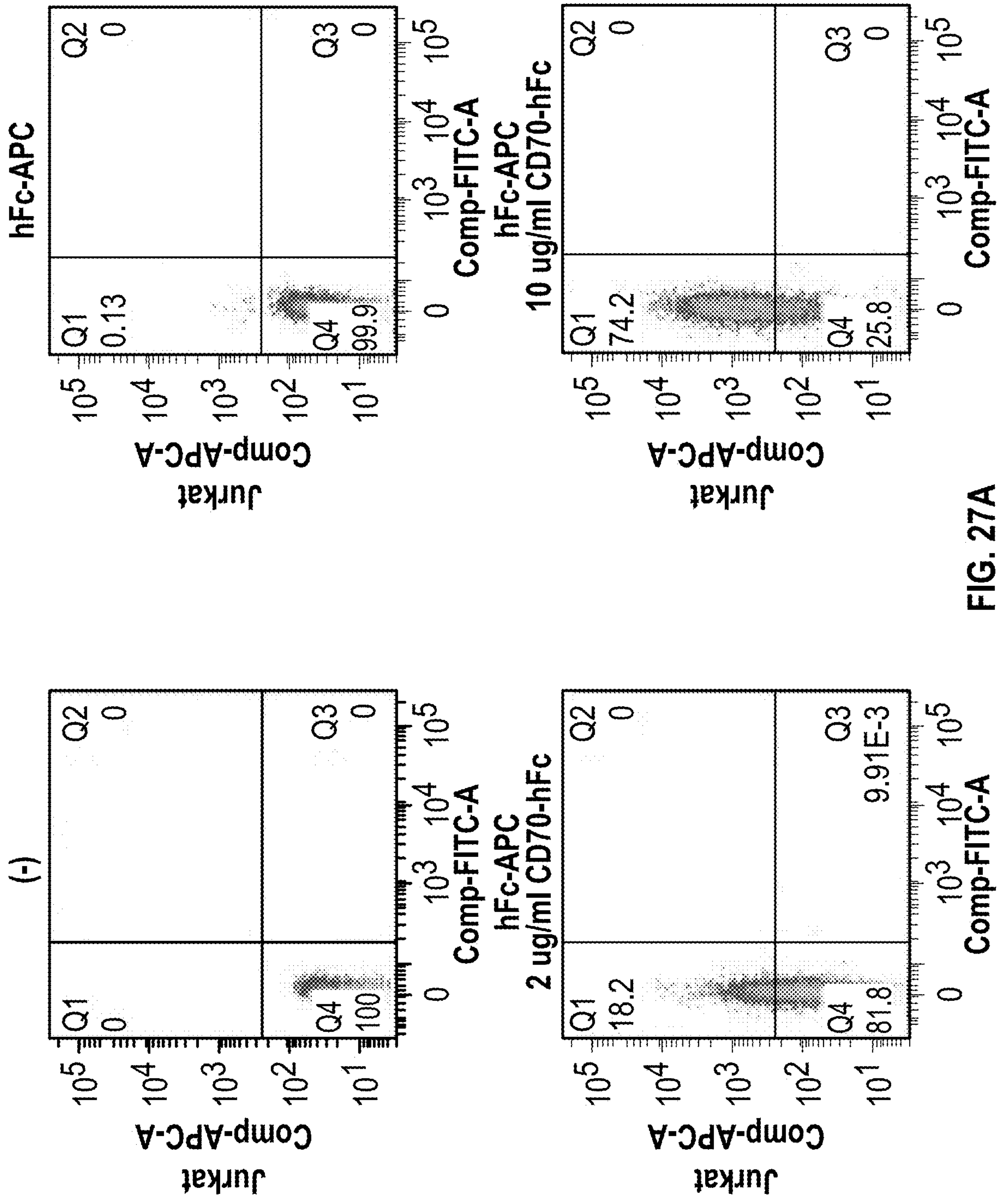
Figure 27B:
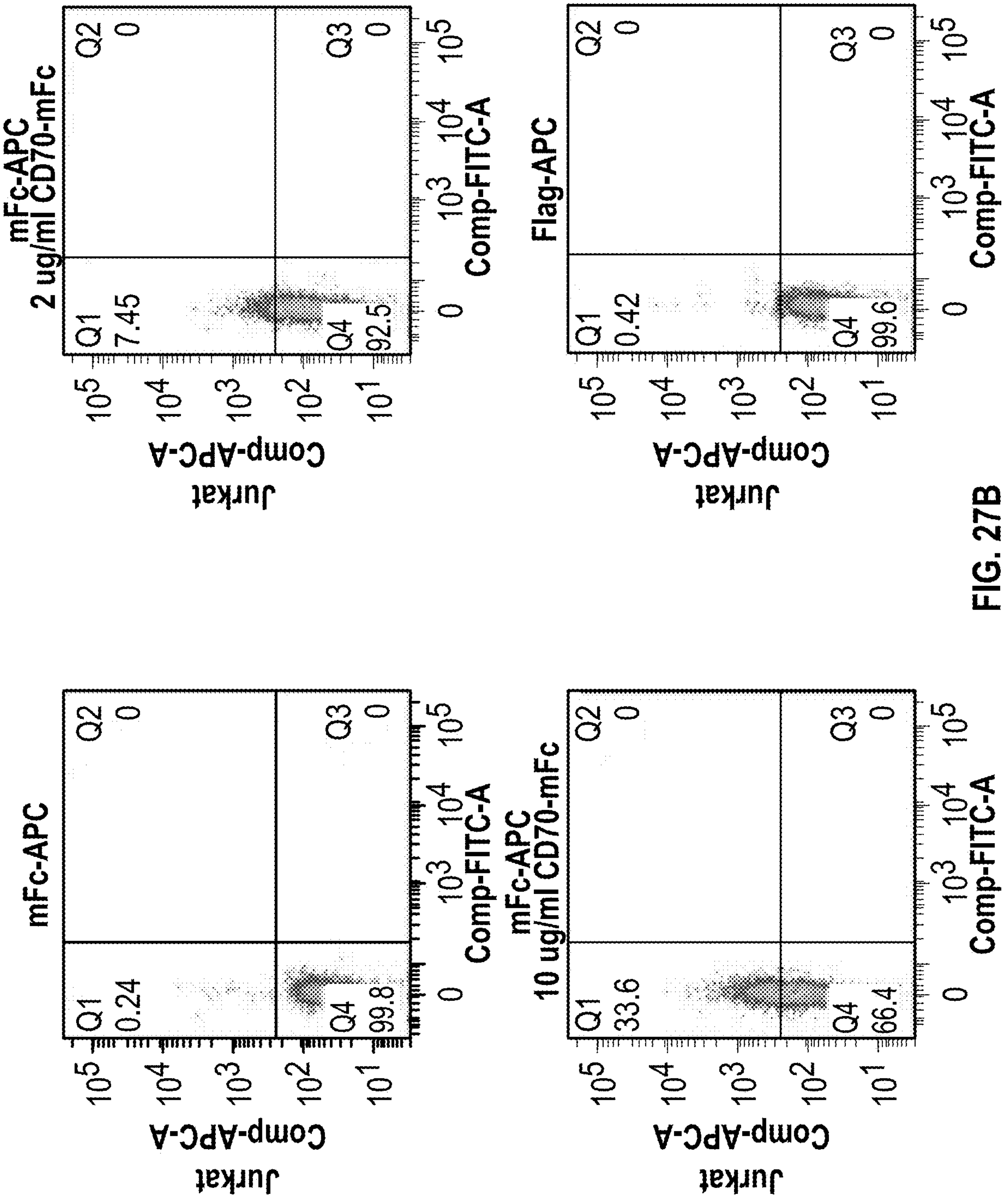
Figure 27C:
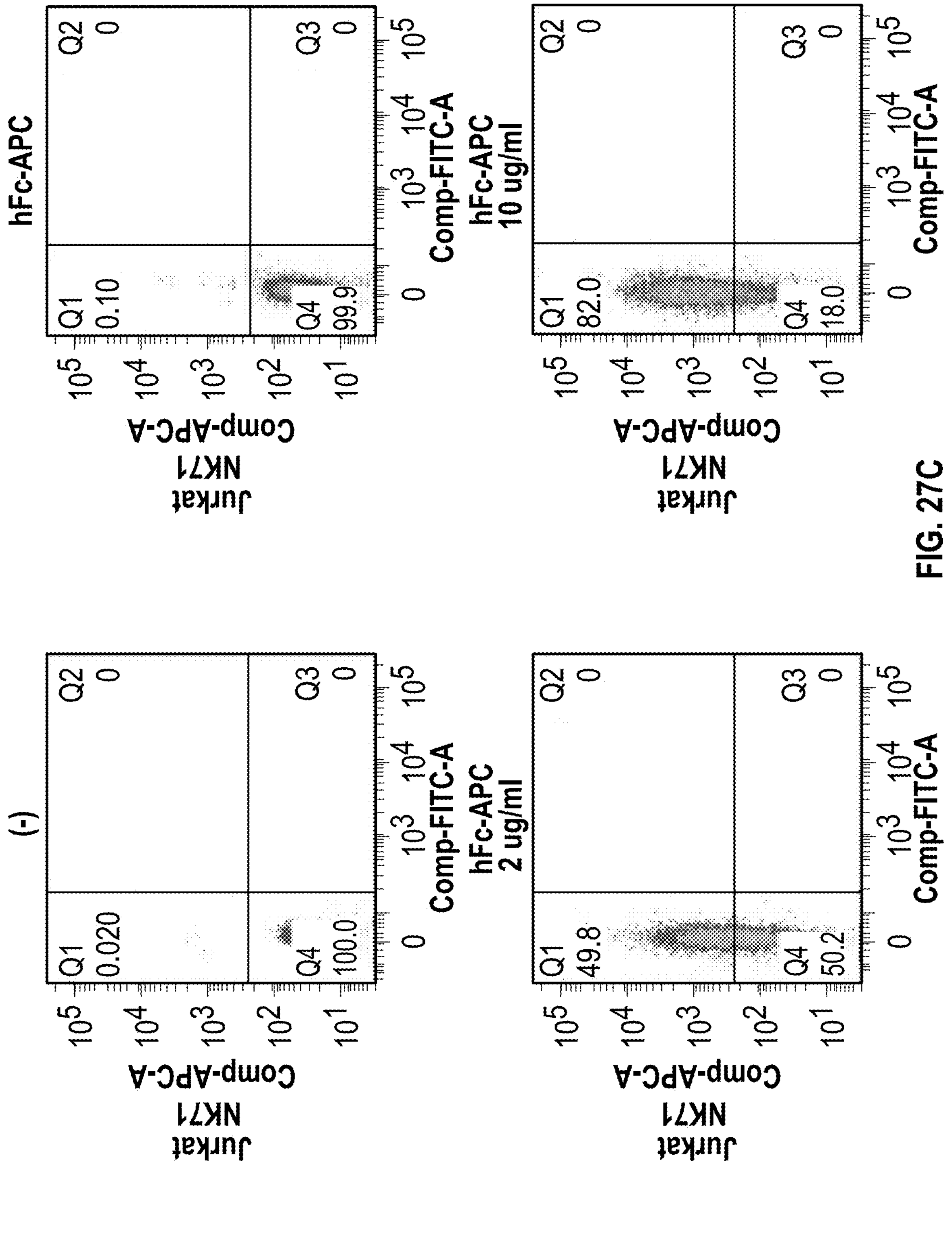
Figure 27D:
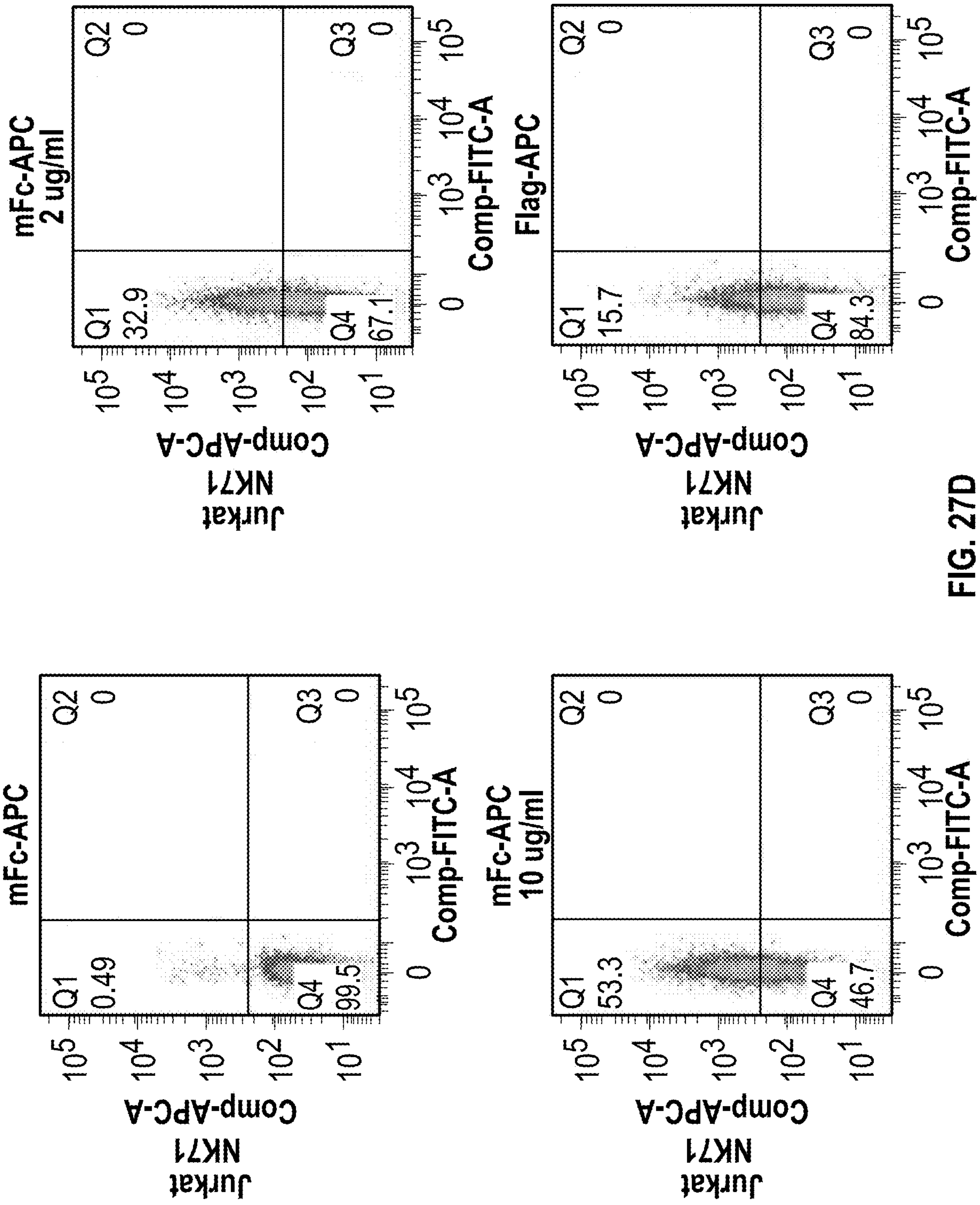
Figure 27E:
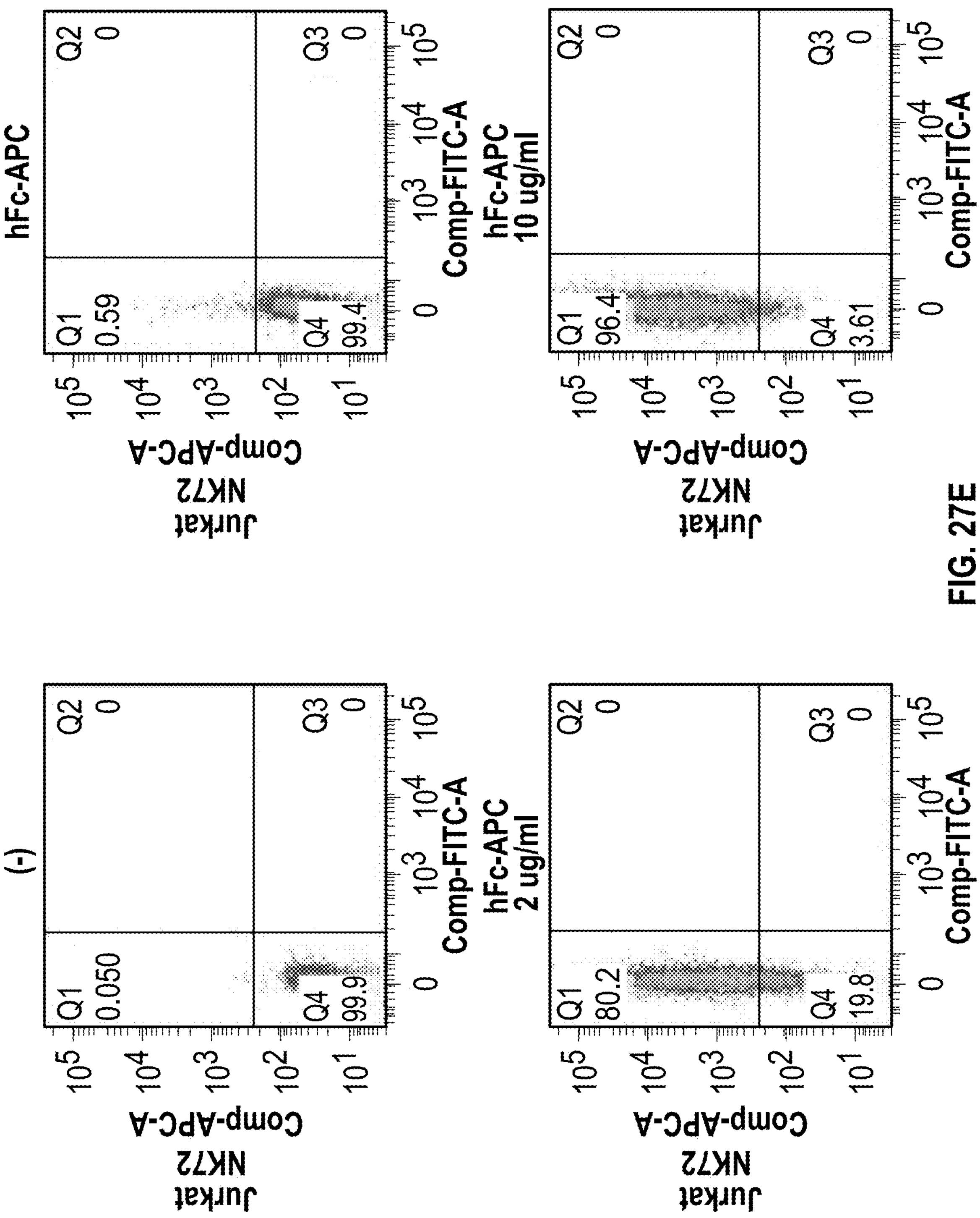
Figure 27F:
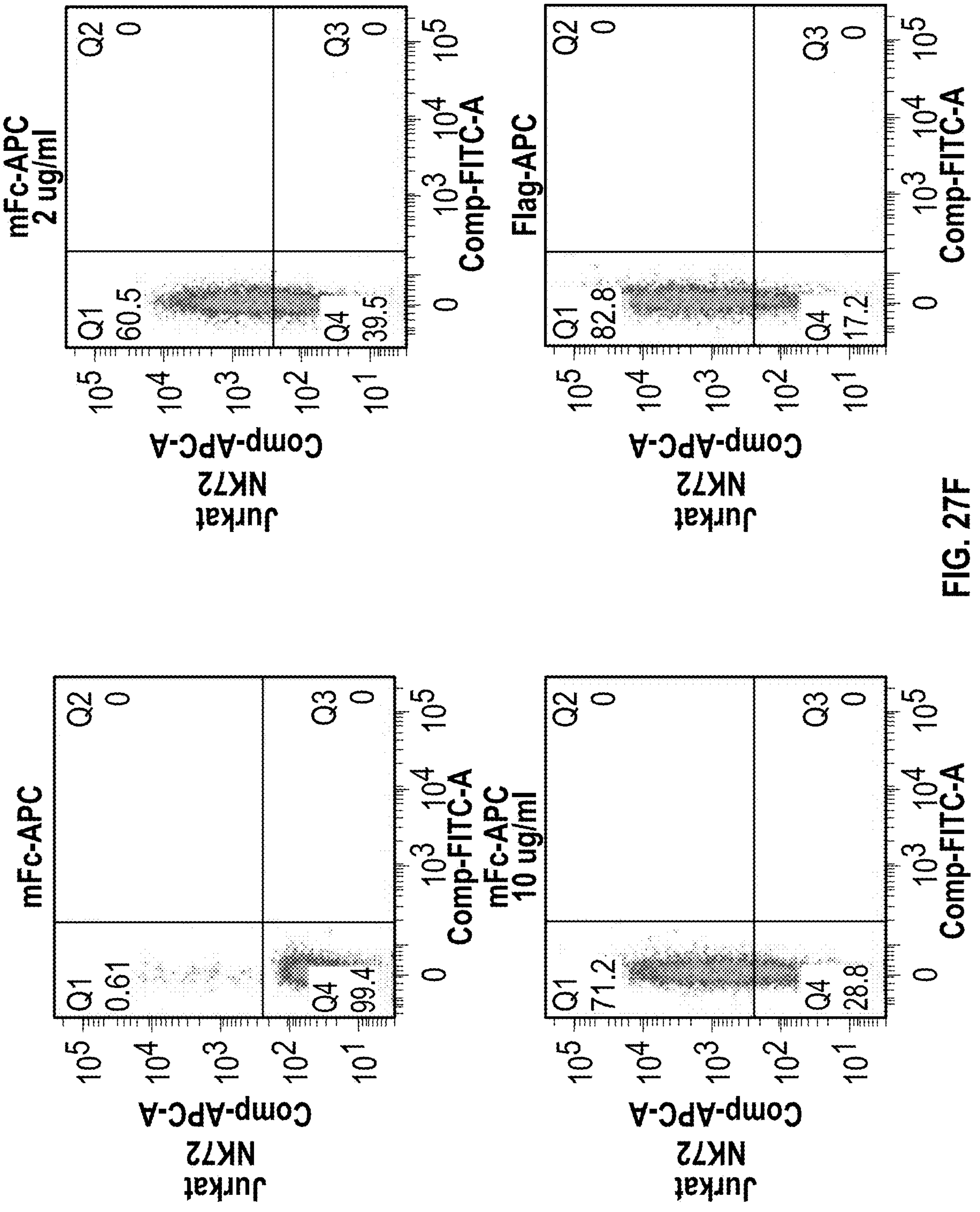

FIGS. 27A-27F show data related to the ability of anti-CD70 CAR-expressing Jurkat cells to bind human bind CD70. FIG. 27A shows data from native Jurkat cells. Moving left to right are negative control, control for the antibody to human Fc, binding when 2 ug/ml of a CD70-hFc complex is incubated with the Jurkat cells and binding is detected with the human Fc-APC antibody, and binding when 10 ug/ml of a CD70-hFc complex is incubated with the Jurkat cells and binding is detected with the human Fc-APC antibody. FIG. 27B shows data from native Jurkat cells. Moving left to right is a control for the antibody to murine Fc, binding when 2 ug/ml of a CD70-murine Fc complex is incubated with the Jurkat cells and binding is detected with a murine Fc-APC antibody, and binding when 10 ug/ml of a CD70-murine Fc complex is incubated with the Jurkat cells and binding is detected with the murine Fc-APC antibody, and detection of Flag tag (present in the NK71/72 CAR constructs, but not native Jurkat cells). FIG. 27C shows data from NK71-expressing Jurkat cells. Moving left to right are negative control, control for the antibody to human Fc, binding when 2 ug/ml of a CD70-hFc complex is incubated with the Jurkat cells and binding is detected with the human Fc-APC antibody, and binding when 10 ug/ml of a CD70-hFc complex is incubated with the Jurkat cells and binding is detected with the human Fc-APC antibody. FIG. 27D shows data from NK71-expressing Jurkat cells. Moving left to right is a control for the antibody to murine Fc, binding when 2 ug/ml of a CD70-murine Fc complex is incubated with the Jurkat cells and binding is detected with a murine Fc-APC antibody, and binding when 10 ug/ml of a CD70-murine Fc complex is incubated with the Jurkat cells and binding is detected with the murine Fc-APC antibody, and detection of Flag tag (present in the NK71/72 CAR constructs, but not native Jurkat cells). FIG. 27E shows data from NK72-expressing Jurkat cells. Moving left to right are negative control, control for the antibody to human Fc, binding when 2 ug/ml of a CD70-hFc complex is incubated with the Jurkat cells and binding is detected with the human Fc-APC antibody, and binding when 10 ug/ml of a CD70-hFc complex is incubated with the Jurkat cells and binding is detected with the human Fc-APC antibody. FIG. 27F shows data from NK72-expressing Jurkat cells. Moving left to right is a control for the antibody to murine Fc, binding when 2 ug/ml of a CD70-murine Fc complex is incubated with the Jurkat cells and binding is detected with a murine Fc-APC antibody, and binding when 10 ug/ml of a CD70-murine Fc complex is incubated with the Jurkat cells and binding is detected with the murine Fc-APC antibody, and detection of Flag tag (present in the NK71/72 CAR constructs, but not native Jurkat cells).

Figures 28A, 28B, 28C:
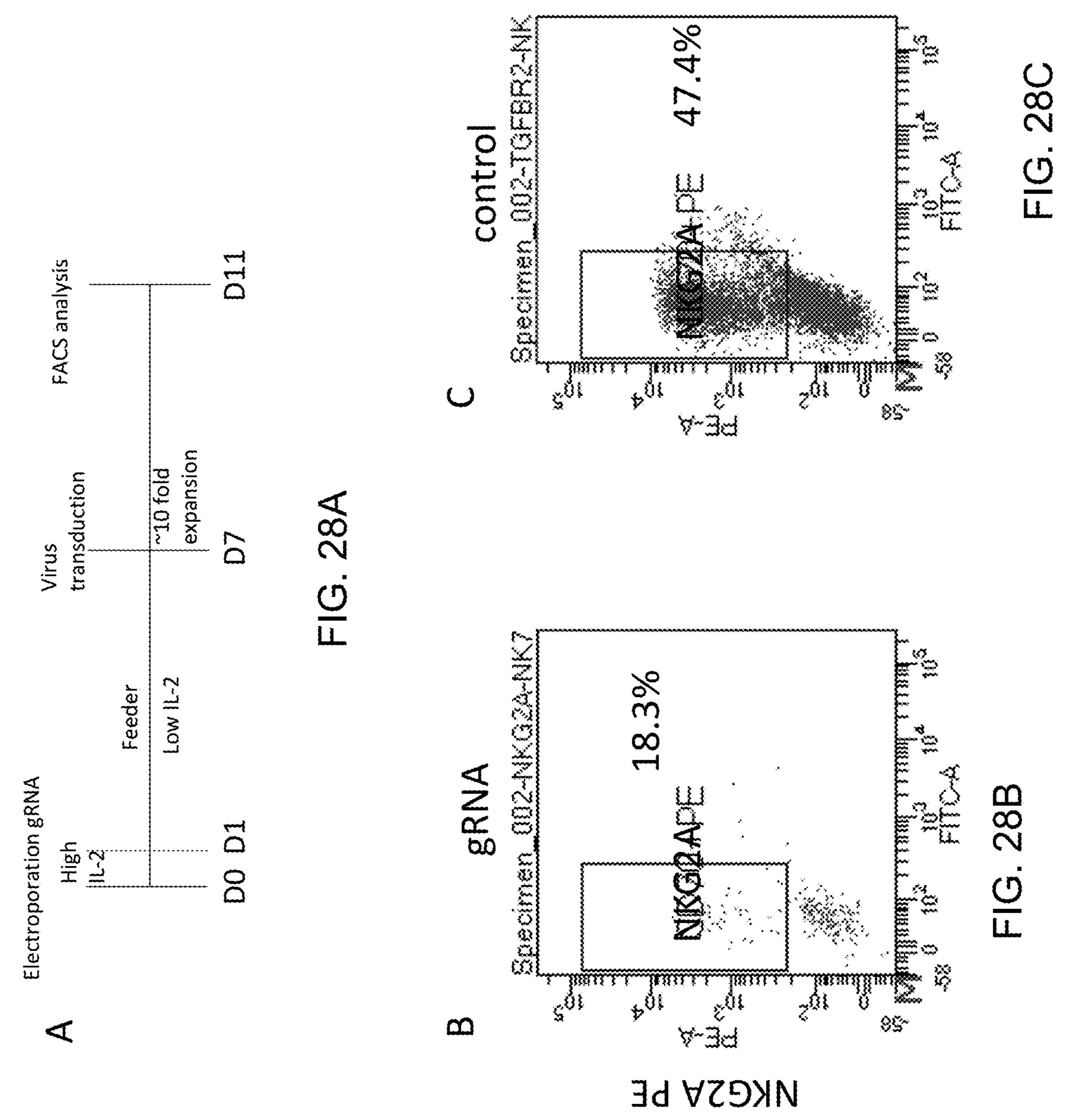
Figure 28D:
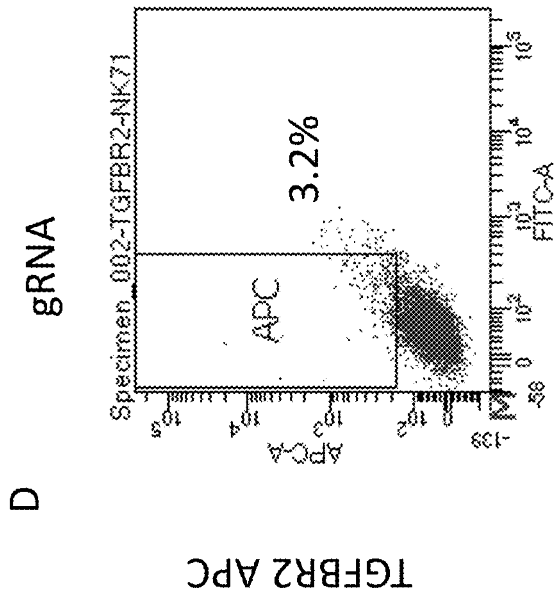
Figure 28E:
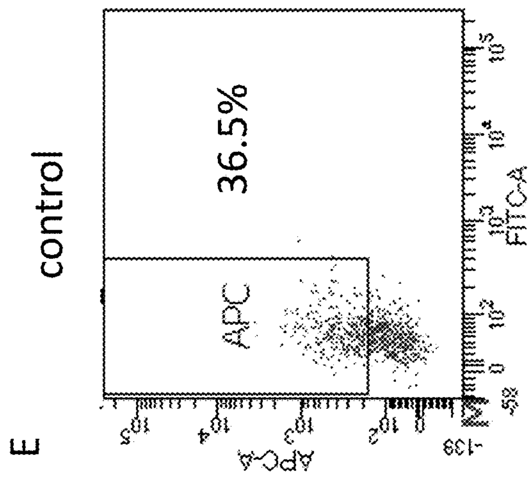

FIGS. 28A-28E shows data related to CRISPR-mediated gene editing of two targets in NK cells. FIG. 28A shows a non-limiting example of an electroporation protocol. In these Figures, expression of NKG2A (in conjunction with CD70) and TGFBR2 (in conjunction with CD70) were assessed. Knockout of CD70 expression is discussed in further detail below. FIG. 28B shows expression of NKG2A after NK cells were exposed to CRISPR/guide RNAs targeting NKG2A. FIG. 28C shows control data. FIG. 28D shows expression of TGFBR2 after NK cells were exposed to CRISPR/guide RNAs targeting TGFBR2. FIG. 28E shows control data.

Figure 29A:
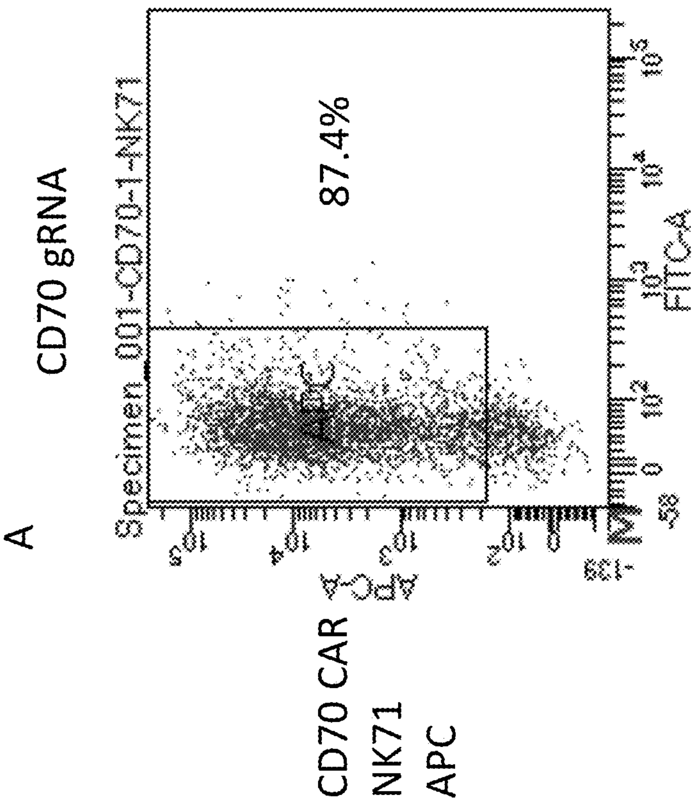
Figure 29B:
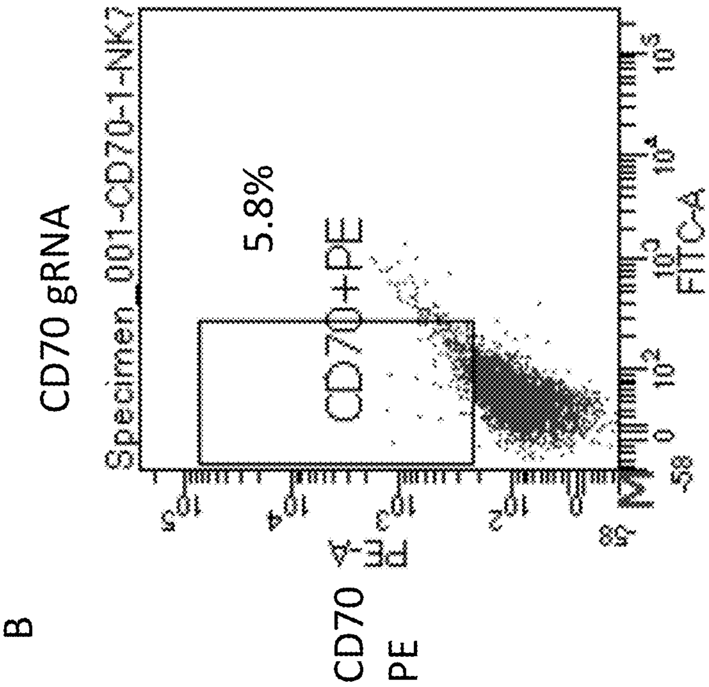
Figure 29D:
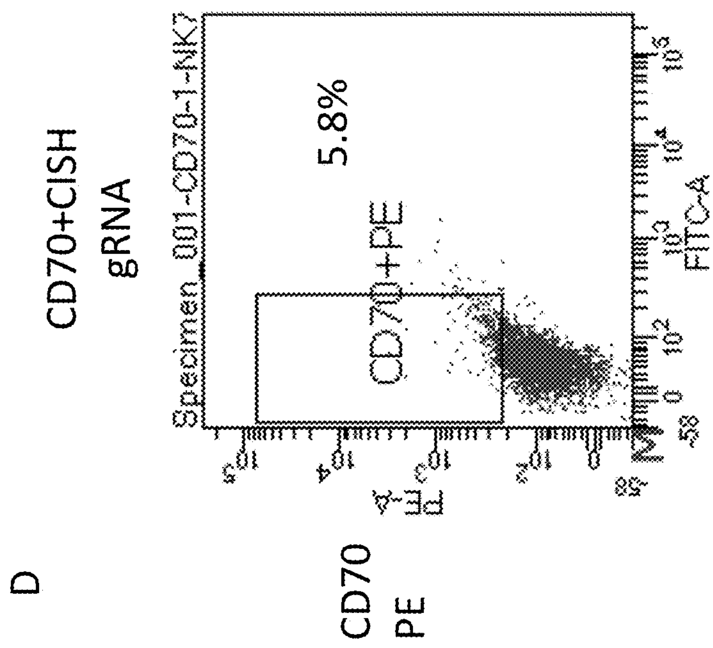
Figure 29C:
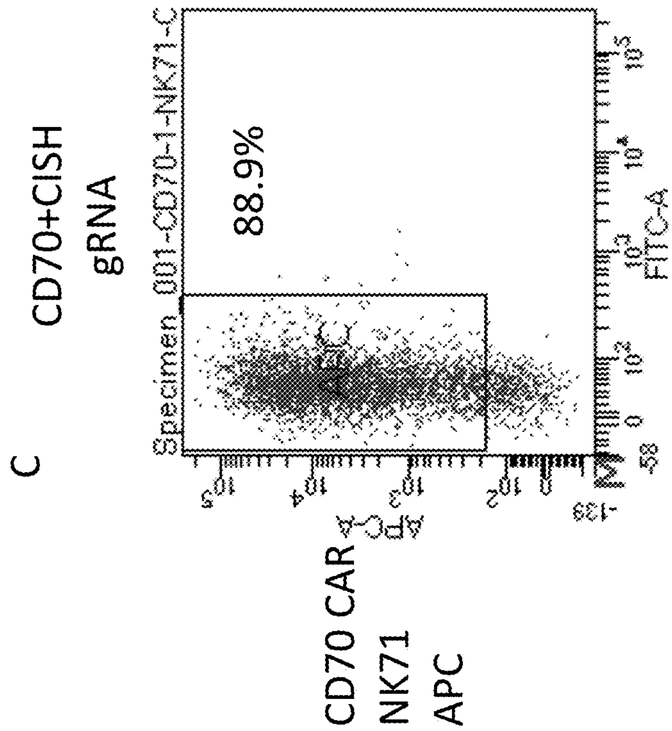
Figure 29E:
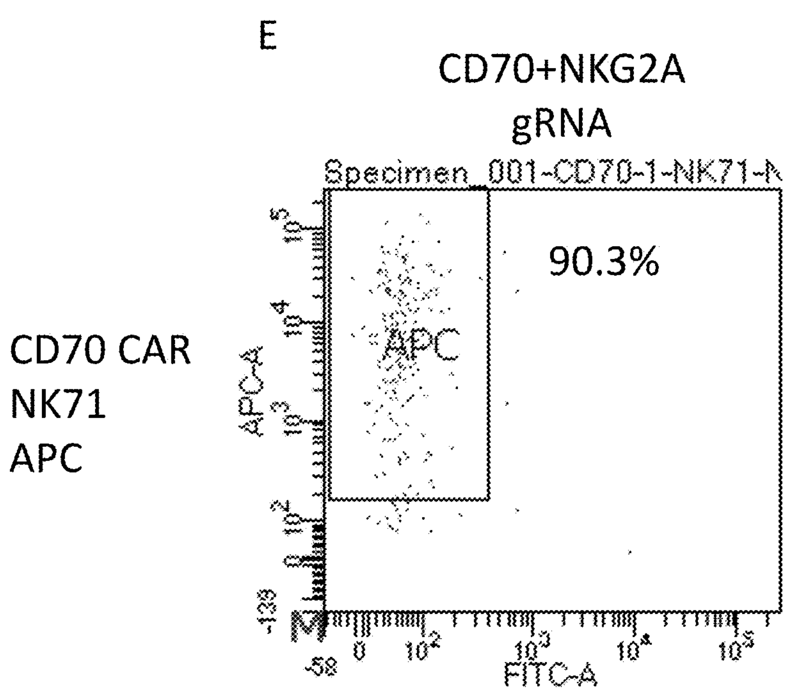
Figure 29F:
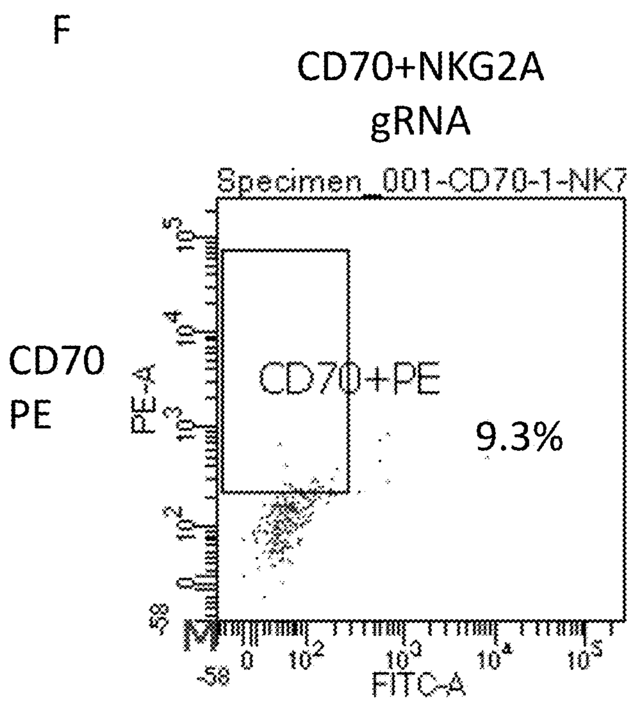
Figure 29G:
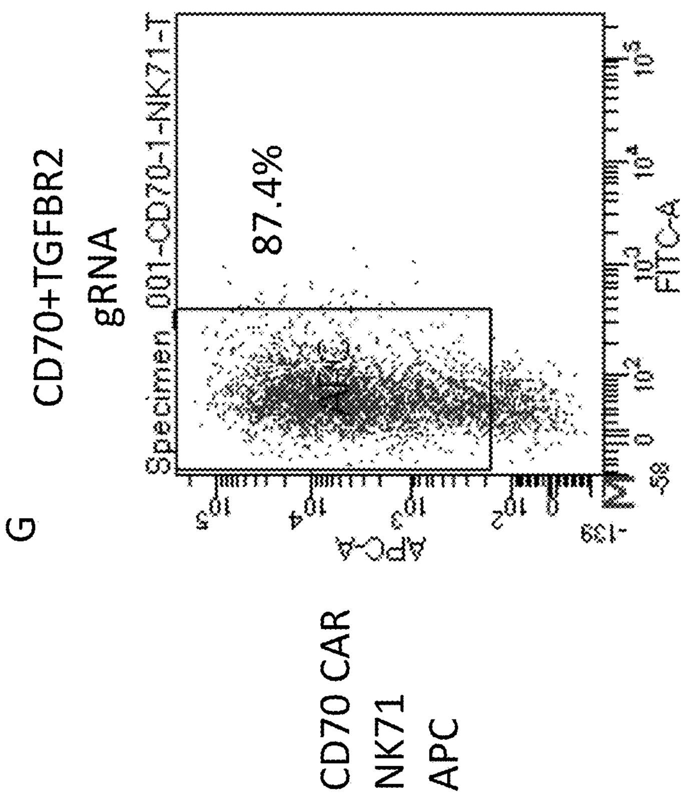
Figure 29H:
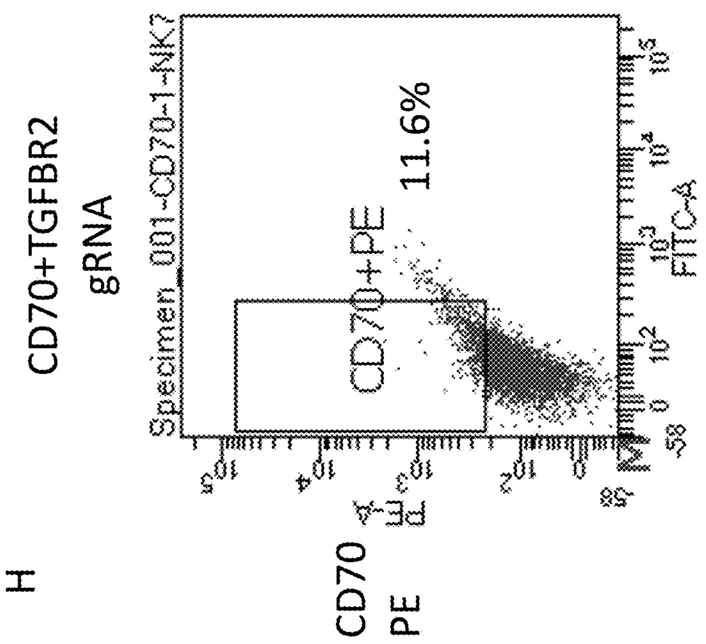
Figure 29I:
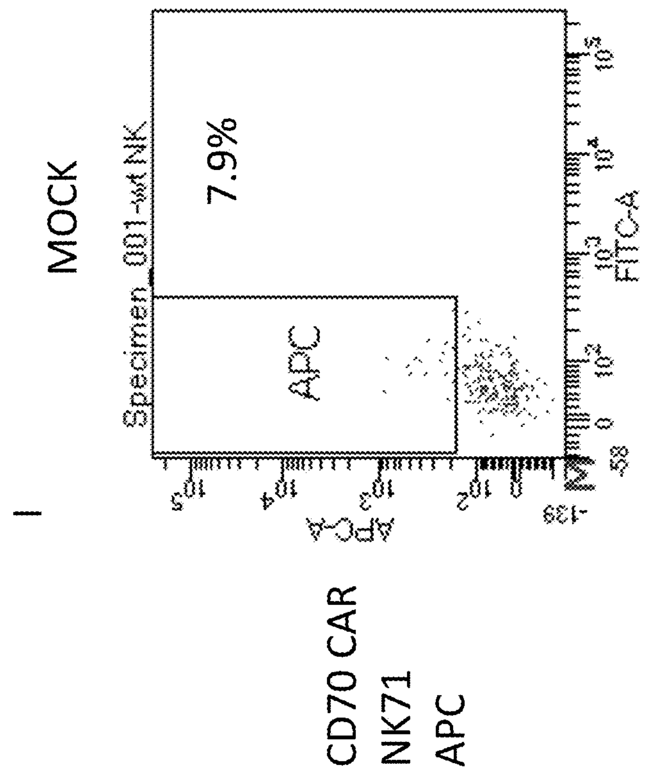
Figure 29J:
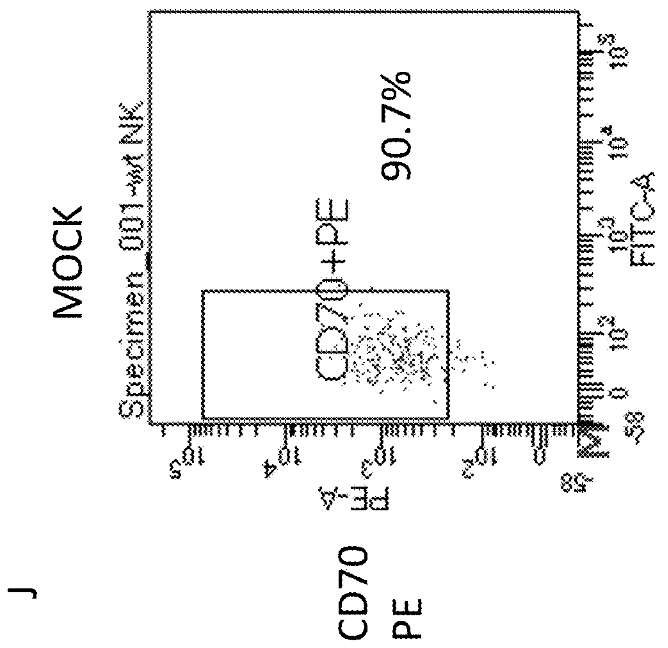

FIGS. 29A-29J shows data related to CRISPR-mediated gene editing of two targets in NK cells and subsequent expression of a CAR construct at 4 days post-transduction with the CAR-encoding vector (11 days post-electroporation). FIG. 29A shows expression of expression of a non-limiting embodiment of a CAR targeting CD70 after NK cells were exposed to CD70 gRNAs. FIG. 29B shows knockdown of expression of CD70 on NK cells through editing targeting by CD70 gRNAs. FIG. 29C shows anti-CD70 CAR expression on the NK cells after NK cells were exposed to CD70 and CISH gRNAs. FIG. 29D shows knockdown of expression of CD70 on NK cells through editing targeting by CD70 gRNAs and CISH gRNAs. FIG. 29E shows anti-CD70 CAR expression on the NK cells after NK cells were exposed to CD70 and NKG2A gRNAs. FIG. 29F shows knockdown of expression of CD70 on NK cells through editing targeting by CD70 gRNAs and NKG2A gRNAs. FIG. 29G shows anti-CD70 CAR expression on the NK cells after NK cells were exposed to CD70 and TGFBR2 gRNAs. FIG. 29H shows knockdown of expression of CD70 on NK cells through editing targeting by CD70 gRNAs and TGFBR2 gRNAs. FIG. 29I shows mock control data for anti-CD70 expression on NK cells. FIG. 29J shows mock control data for CD70 expression on NK cells.

Figure 30A:
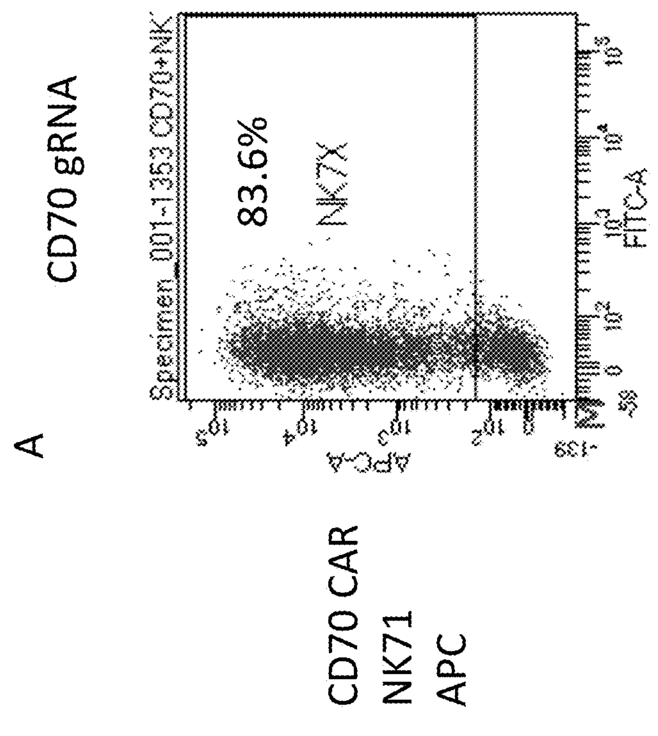
Figure 30B:
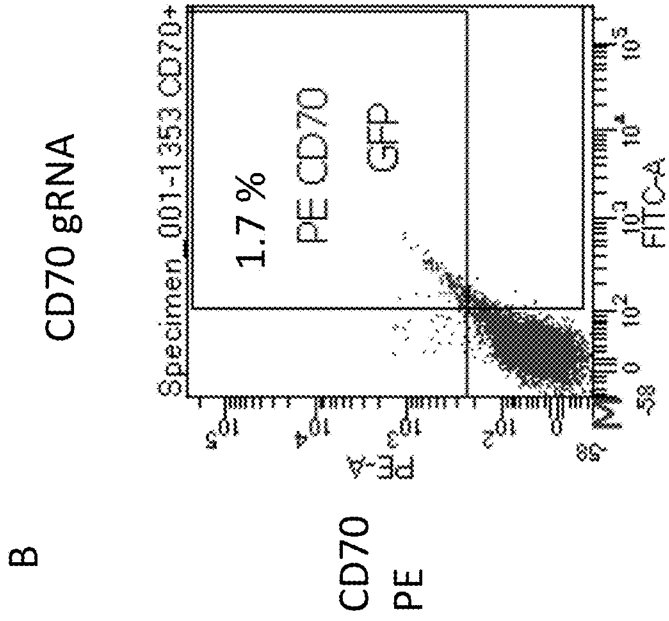
Figure 30C:
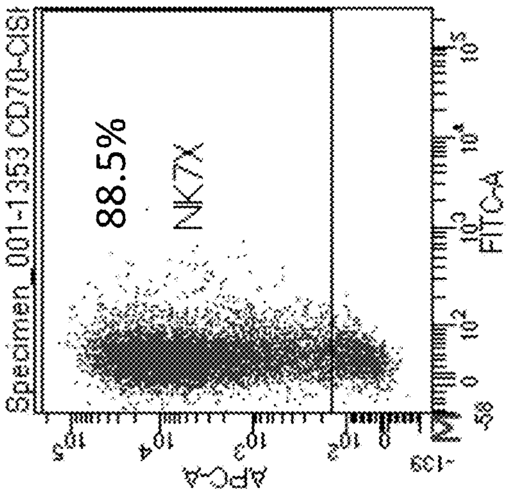
Figure 30D:
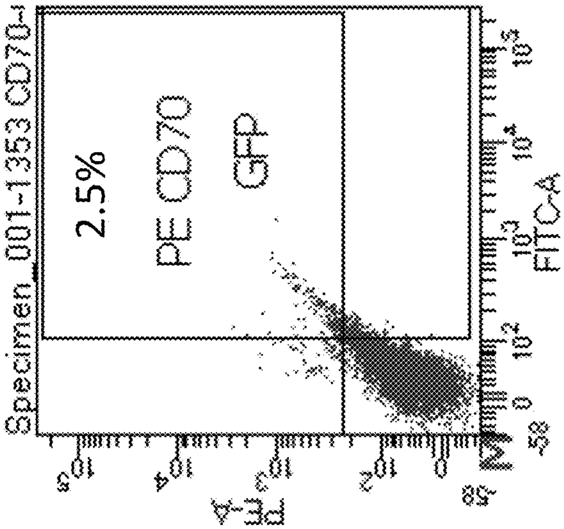
Figure 30F:
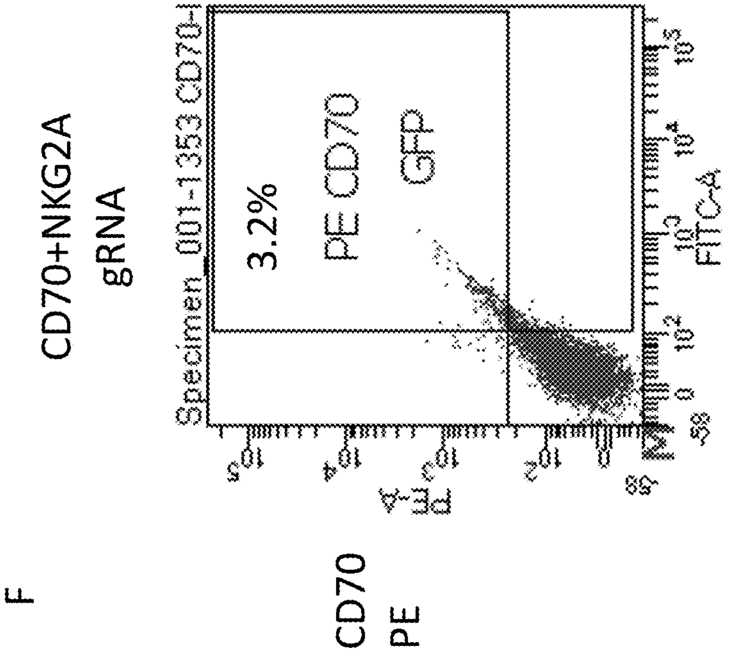
Figure 30E:
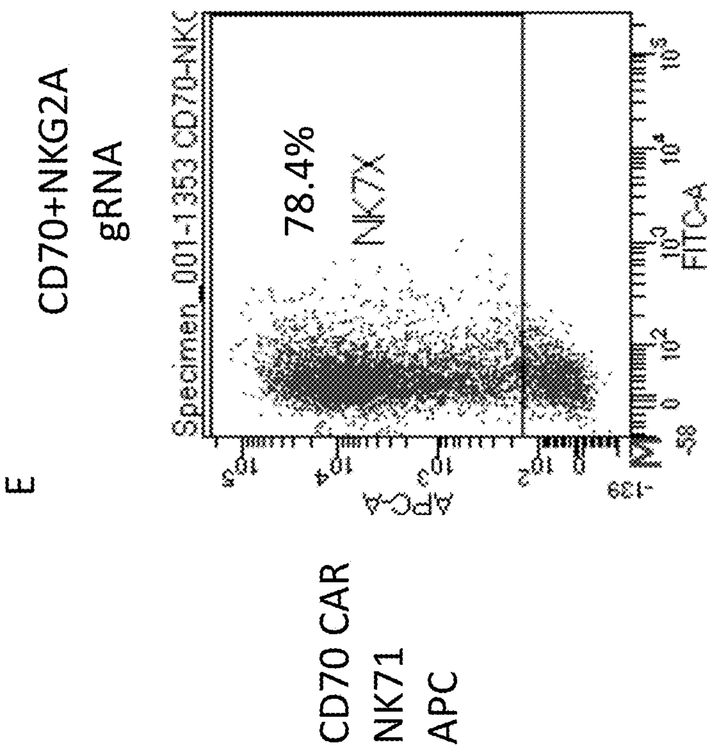
Figure 30H:
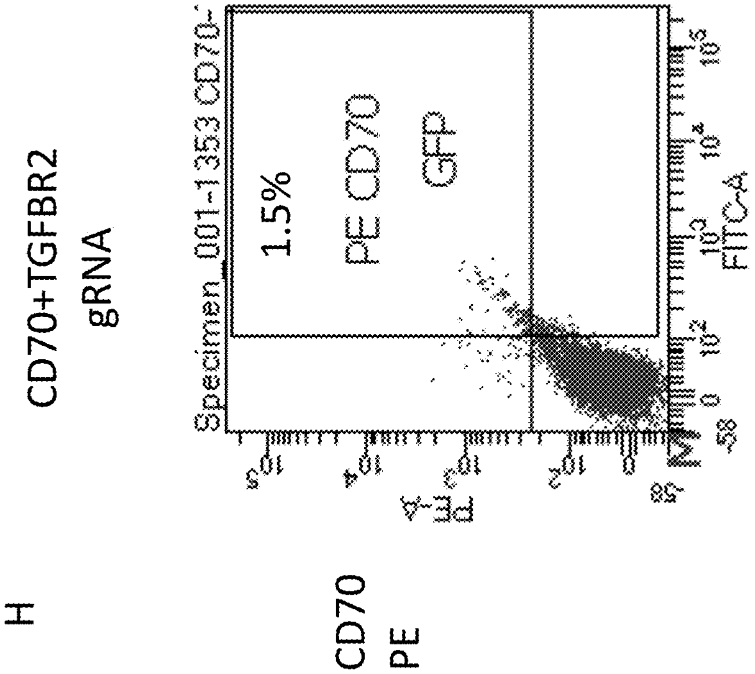
Figure 30G:
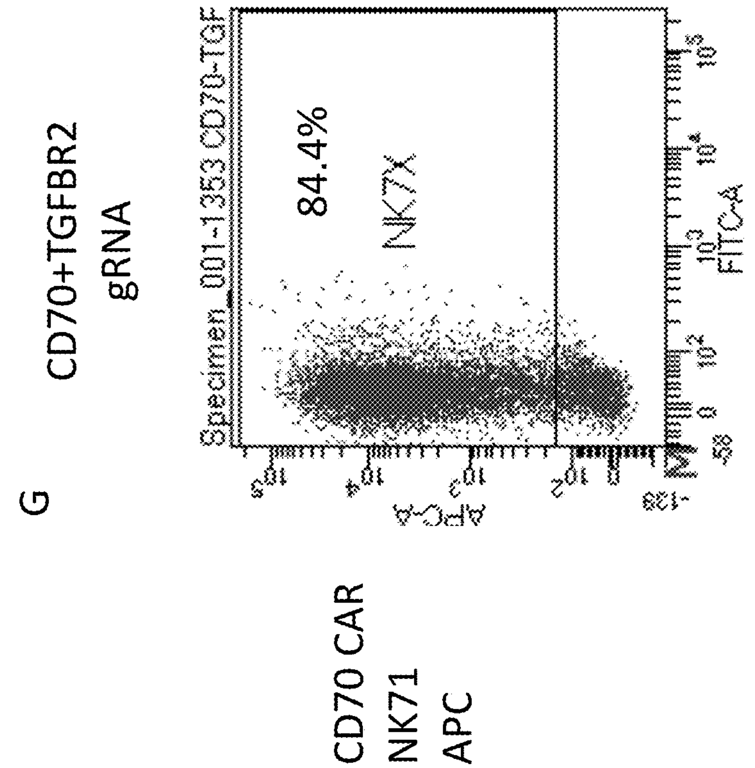
Figure 30J:
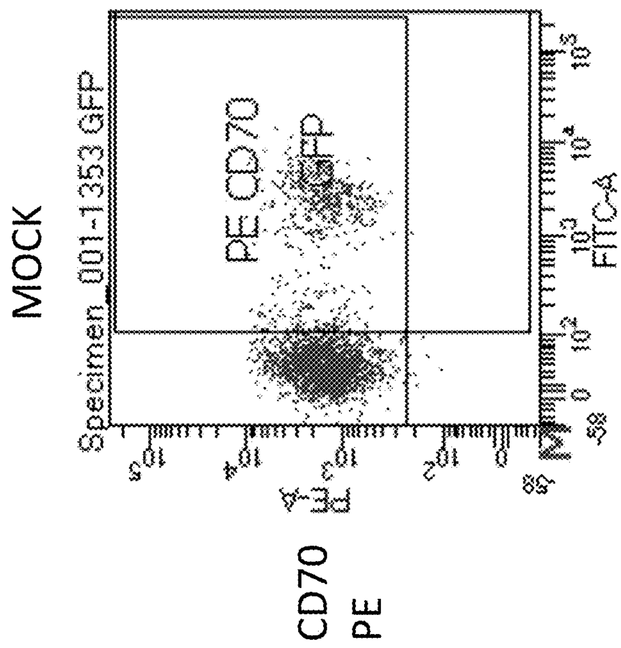
Figure 30I:
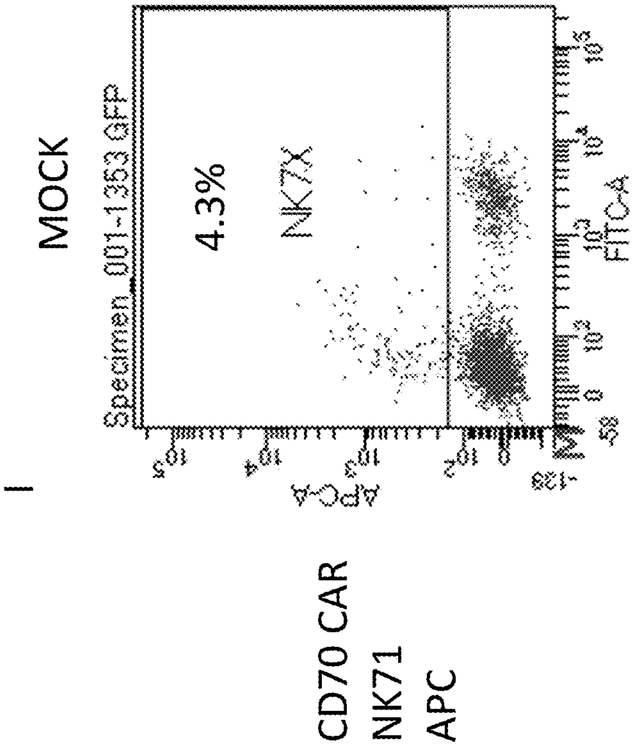

FIGS. 30A-30J shows data related to CRISPR-mediated gene editing of two targets in NK cells and subsequent expression of a CAR construct at 11 days post-transduction with the CAR-encoding vector (18 days post-electroporation). FIG. 30A shows expression of a non-limiting embodiment of a CAR targeting CD70 after NK cells were exposed to CD70 gRNAs. FIG. 30B shows knockdown of expression of CD70 on NK cells through editing targeting by CD70 gRNAs. FIG. 30C shows anti-CD70 CAR expression on the NK cells after NK cells were exposed to CD70 and CISH gRNAs. FIG. 30D shows knockdown of expression of CD70 on NK cells through editing targeting by CD70 gRNAs and CISH gRNAs. FIG. 30E shows anti-CD70 CAR expression on the NK cells after NK cells were exposed to CD70 and NKG2A gRNAs. FIG. 30F shows knockdown of expression of CD70 on NK cells through editing targeting by CD70 gRNAs and NKG2A gRNAs. FIG. 30G shows anti-CD70 CAR expression on the NK cells after NK cells were exposed to CD70 and TGFBR2 gRNAs. FIG. 30H shows knockdown of expression of CD70 on NK cells through editing targeting by CD70 gRNAs and TGFBR2 gRNAs. FIG. 30I shows mock control data for anti-CD70 expression on NK cells. FIG. 30J shows mock control data for CD70 expression on NK cells.

Figure 31A:
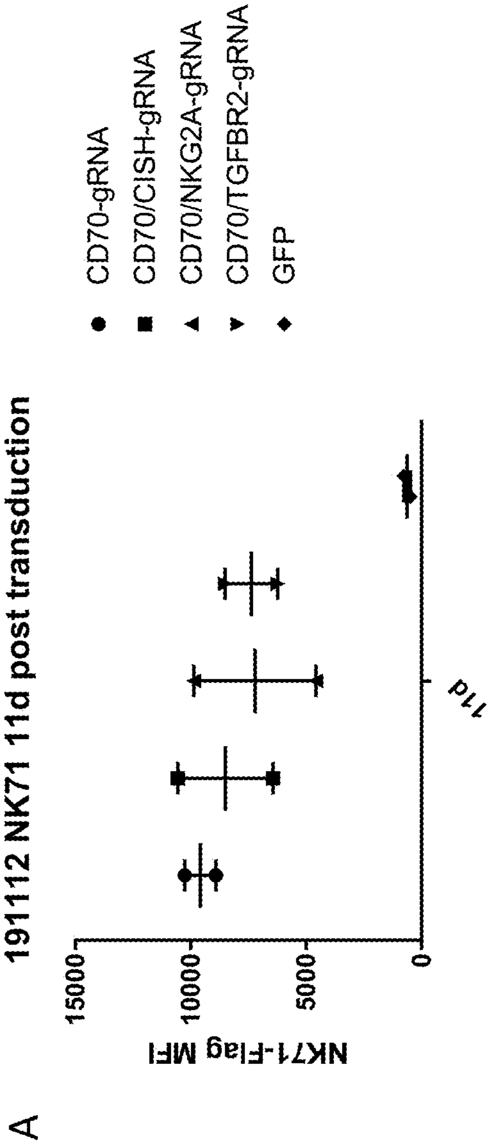
Figure 31B:
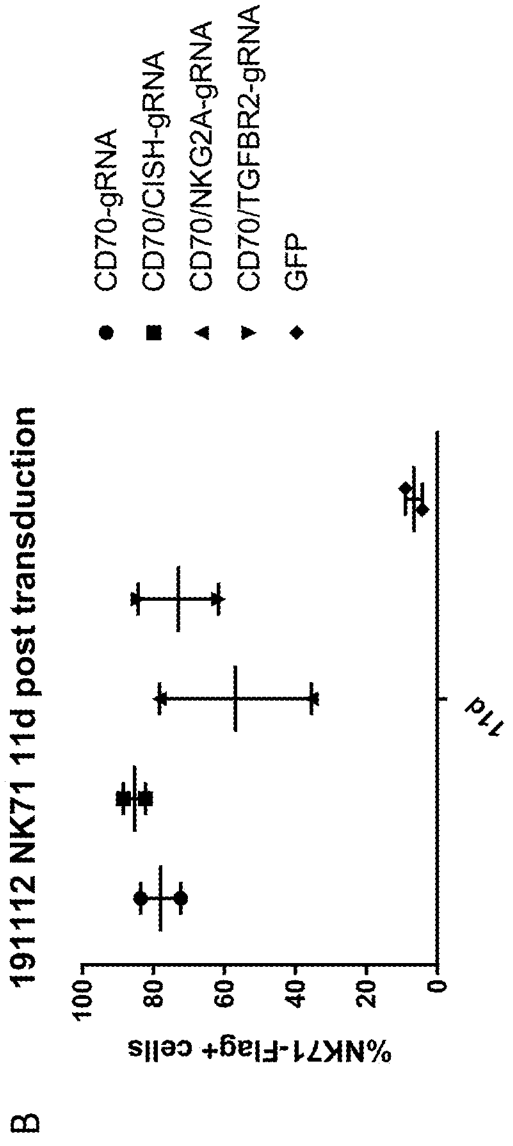
Figure 31C:
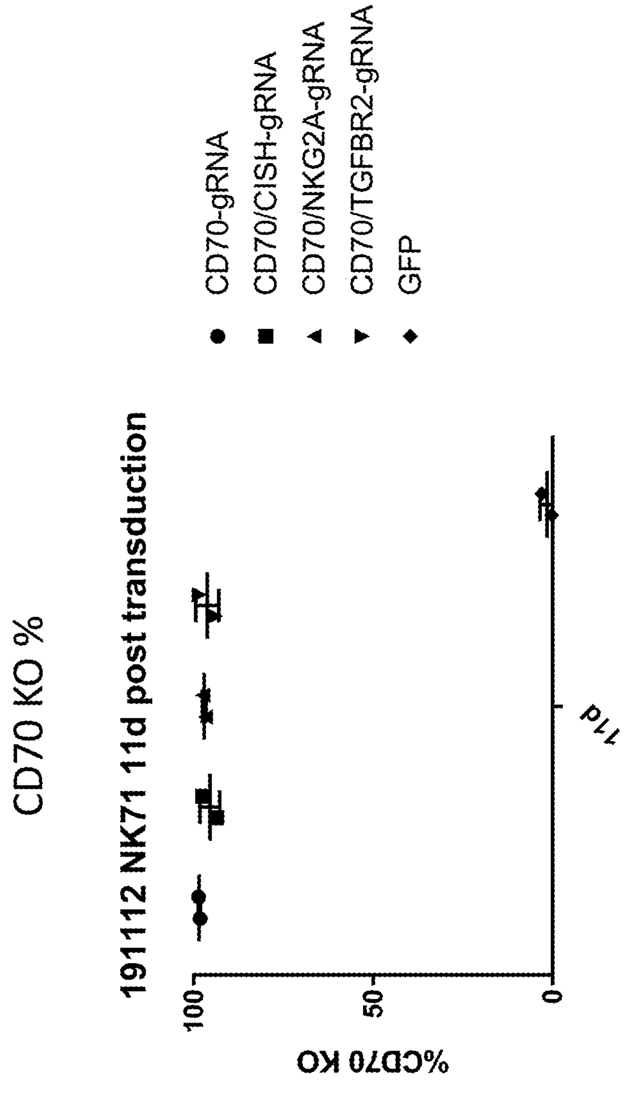

FIGS. 31A-31C show summary expression data for a first non-limiting embodiment of an anti-CD70 CAR on NK cells subject to gene-editing knockdown of one or more targets, evaluated at 11 days post-transduction. FIG. 31A shows the expression levels of a first non-limiting anti-CD70 CAR (NK71) on NK cells treated with CD70 gRNA, CD70 and CISH gRNAs, CD70 and NKG2A gRNAs, CD70 and TGFBR2 gRNAs, or with GFP. Data are the percentage of NK cells positive for the FLAG tag in the NK71 CAR construct (several embodiments do not employ a FLAG tag). FIG. 31B shows the underlying raw mean fluorescence intensity (MFI) data. FIG. 31C shows data related to the degree of CD70 knockout in the NK cells with the indicated gRNAs.

Figure 32A:
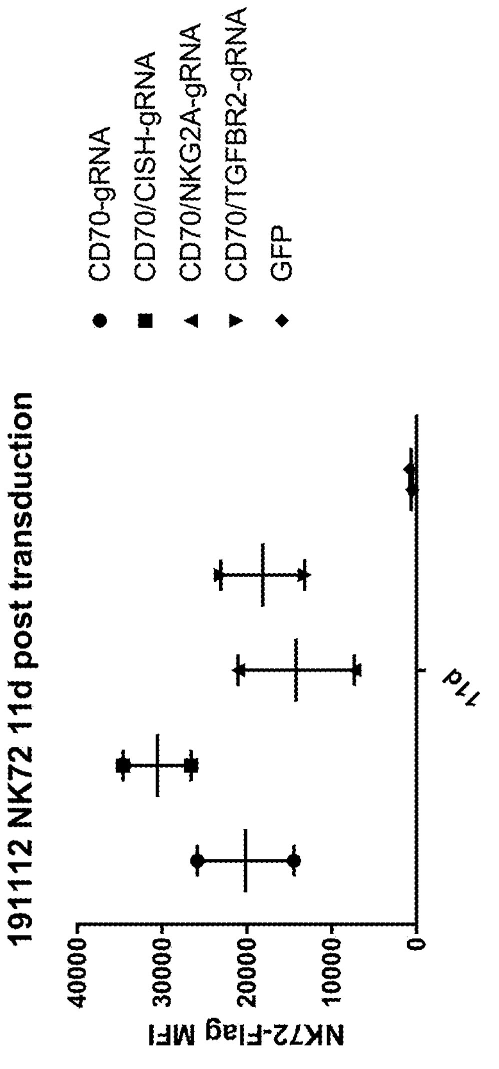
Figure 32B:
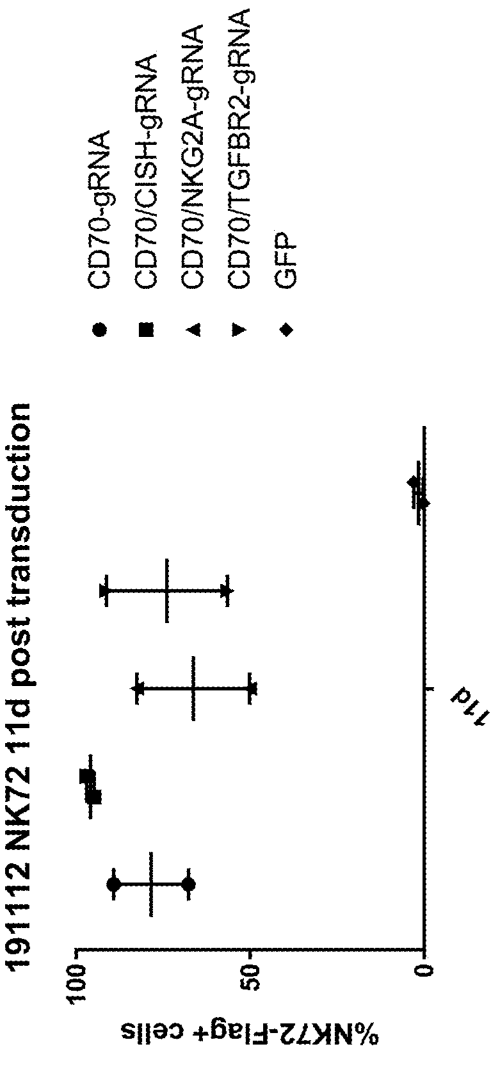
Figure 32C:
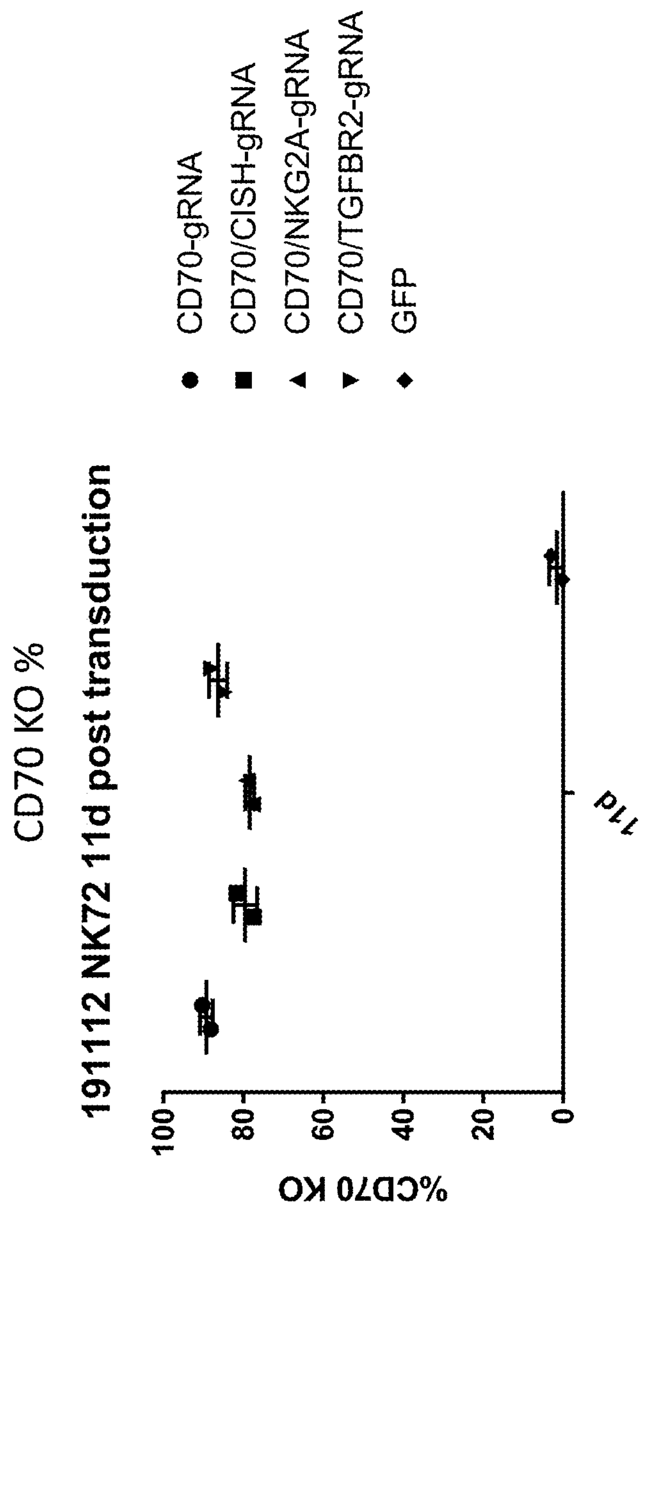

FIGS. 32A-32C show summary expression data for a second non-limiting embodiment of an anti-CD70 CAR on NK cells subject to gene-editing knockdown of one or more targets, evaluated at 11 days post-transduction. FIG. 32A shows the expression levels of a first non-limiting anti-CD70 CAR (NK72) on NK cells treated with CD70 gRNA, CD70 and CISH gRNAs, CD70 and NKG2A gRNAs, CD70 and TGFBR2 gRNAs, or with GFP. Data are the percentage of NK cells positive for the FLAG tag in the NK72 CAR construct (several embodiments do not employ a FLAG tag). FIG. 32B shows the underlying raw mean fluorescence intensity (MFI) data. FIG. 32C shows data related to the degree of CD70 knockout in the NK cells with the indicated gRNAs.

Figure 33A:
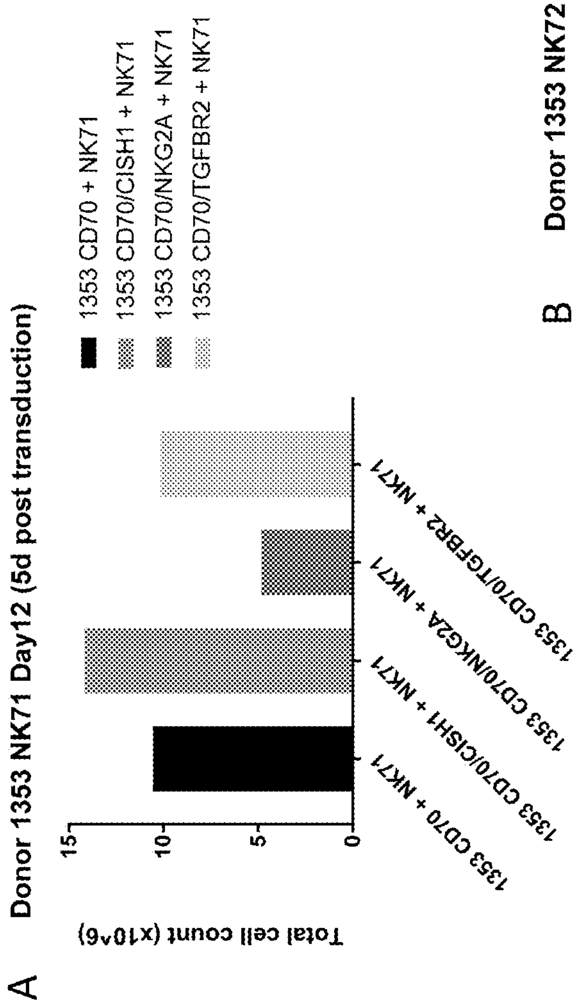
Figure 33B:
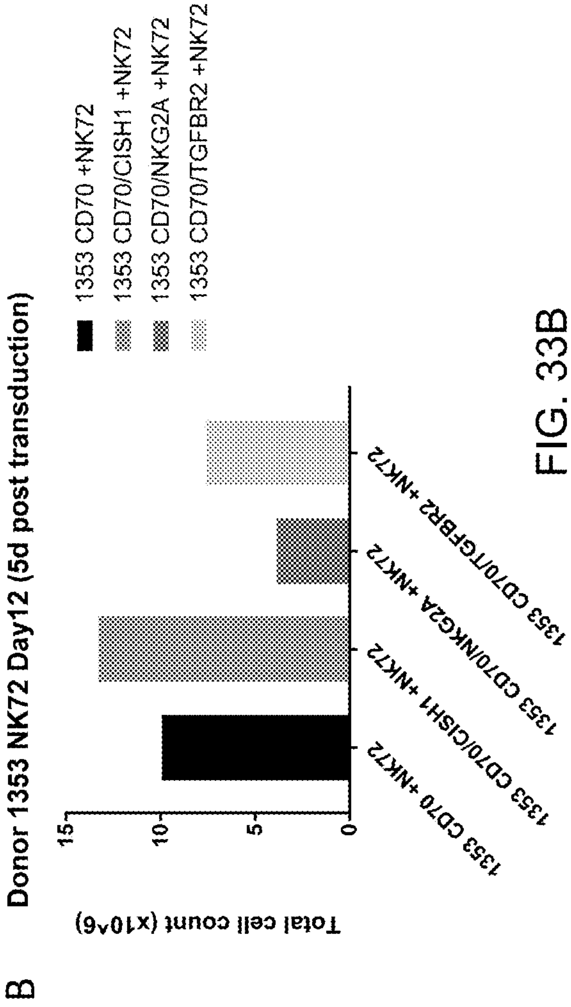

FIGS. 33A-33B show data related to the changes in NK cell proliferation based on knockout of different targets in the NK cells and engineering the NK cells to express an anti-CD70 CAR. FIG. 33A shows data that knockdown of CD70 expression and engineered expression of an anti-CD70 CAR (this experiment used the non-limiting NK71 construct) and knockdown of CISH expression results in enhanced NK cell proliferation (as compared to knockdown of CD70 alone. Similar data are shown when CD70 and TGFRB2 are knockout. In contrast, knockdown of NKG2A results in decreased proliferation (as compared to CD70 knockout alone). FIG. 33B shows corresponding data for proliferation when the NK cells are subjected to the same gene editing procedures, but transduced with a construct encoding the non-limiting example anti-CD70 CAR, NK72.

Figure 34A:
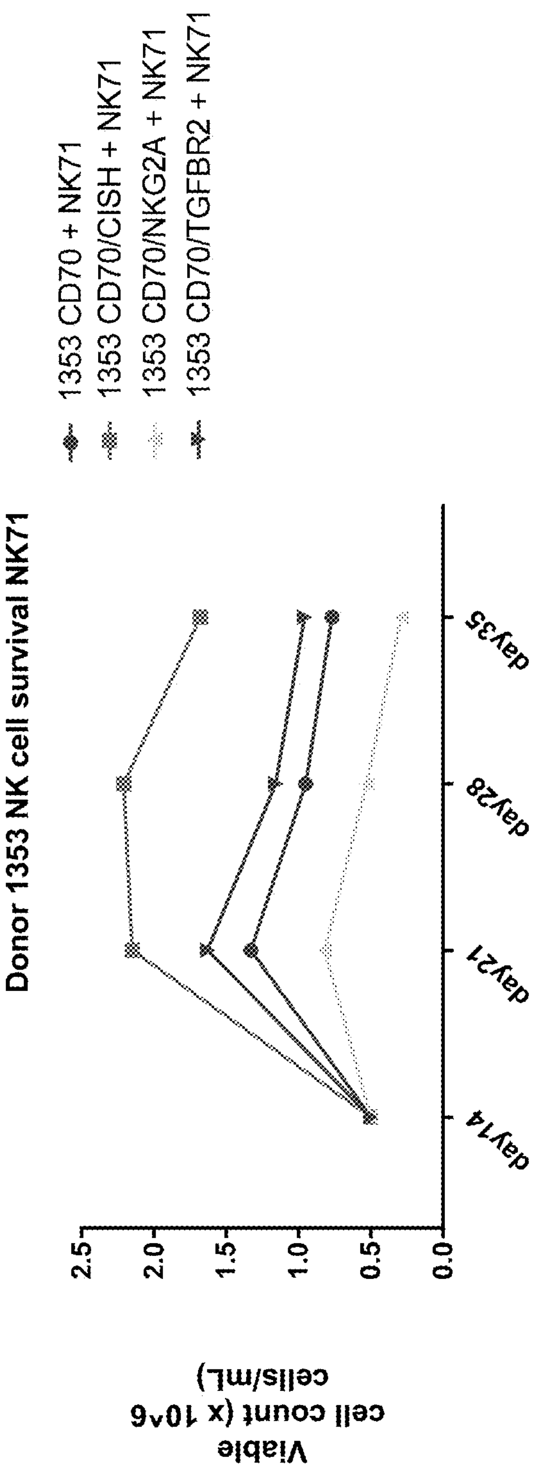
Figure 34B:
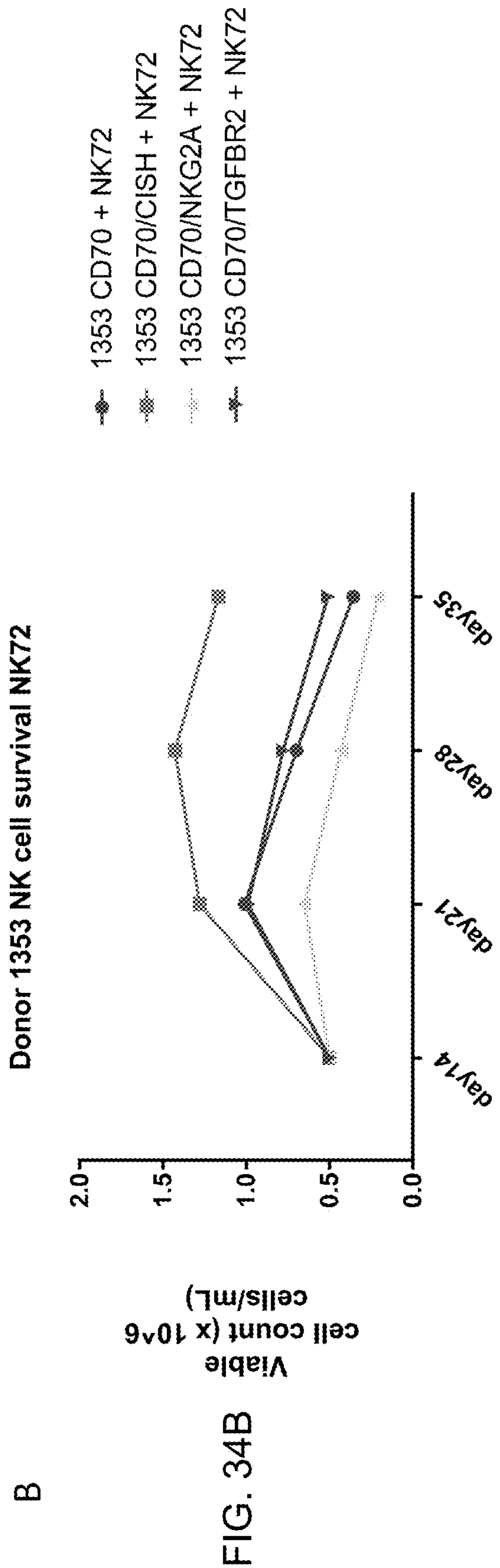

FIGS. 34A-34B show data related to NK cell survival based on knockout of different targets in the NK cells and engineering the NK cells to express an anti-CD70 CAR. FIG. 34A shows survival data for NK cells engineered to express the non-limiting NK71 anti-CD70 CAR out to 35 days (post-electroporation). As shown, the double knockout of CD70 and TGFBR2 result in modestly improved survival throughout the experimental time-course (as compared to the CD70 knockout). The dual CD70 and CISH knockout resulted in significantly enhanced survival with approximately a 2-fold increase in survival (as compared to CD70 alone). The knockout of NKG2A resulted in a reduction in survival, with the NK population slowly declining from Day 21 to Day 35. The reduced survival of this group makes the survival of the CD70-CISH dual knockout nearly 3 times that of the NKG2A group. FIG. 34B shows similar trends among the groups for the non-limiting NK72 anti-CD70 CAR. These data also suggest that, according to some embodiments, the NK71 construct results in enhanced survival as compared to the NK72 construct.

Figure 35A:
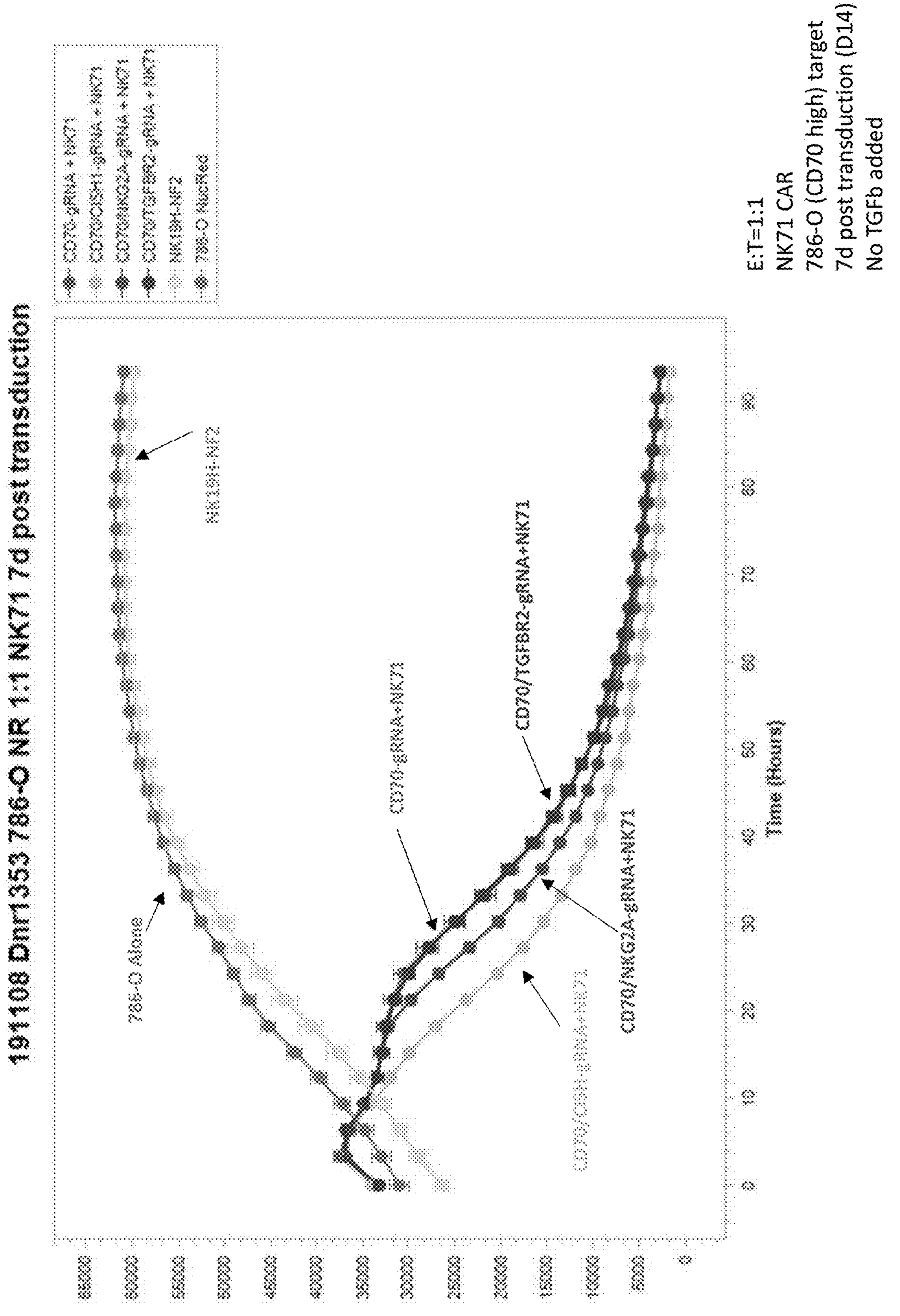
Figure 35B:
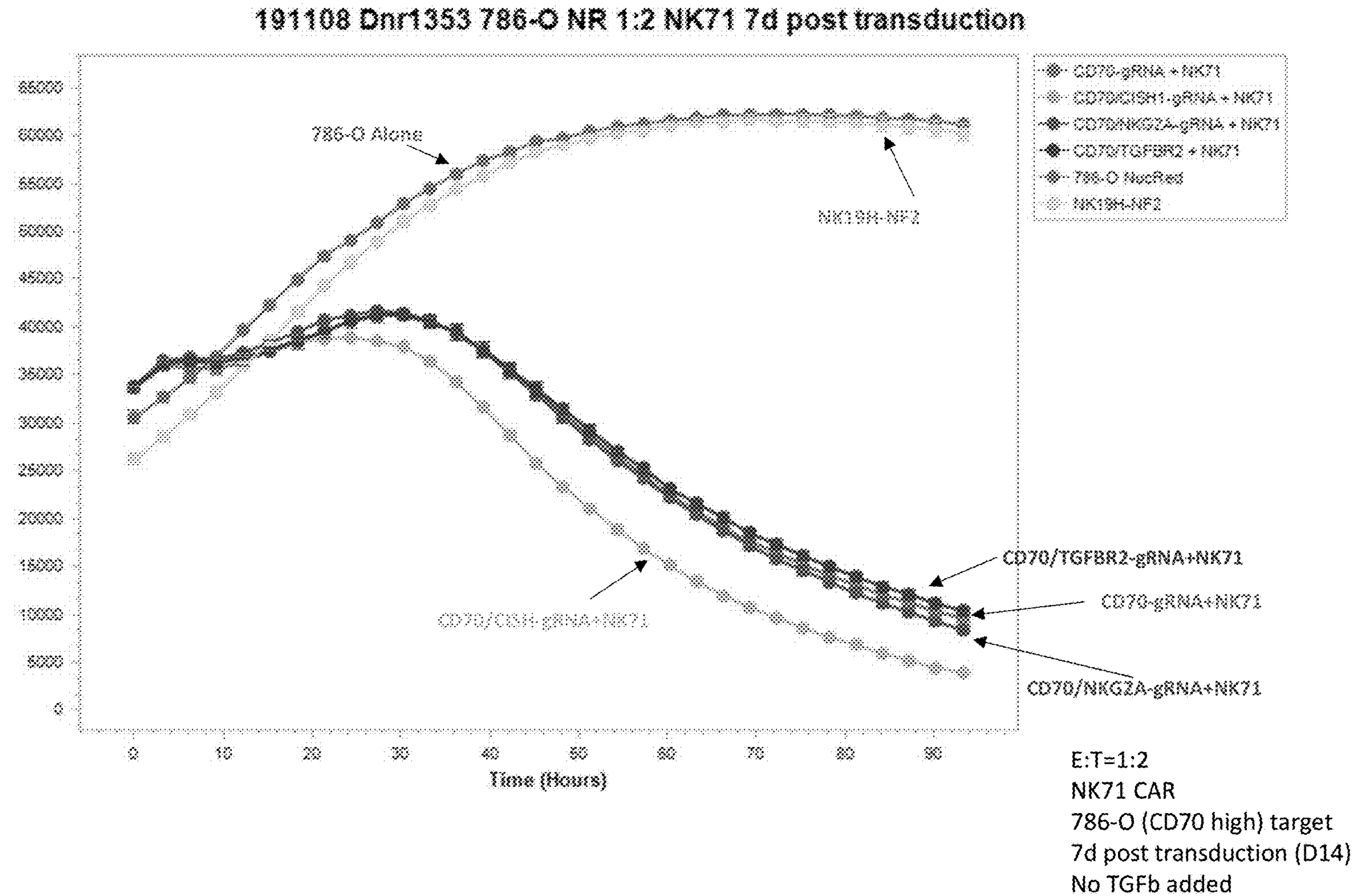
Figure 35C:
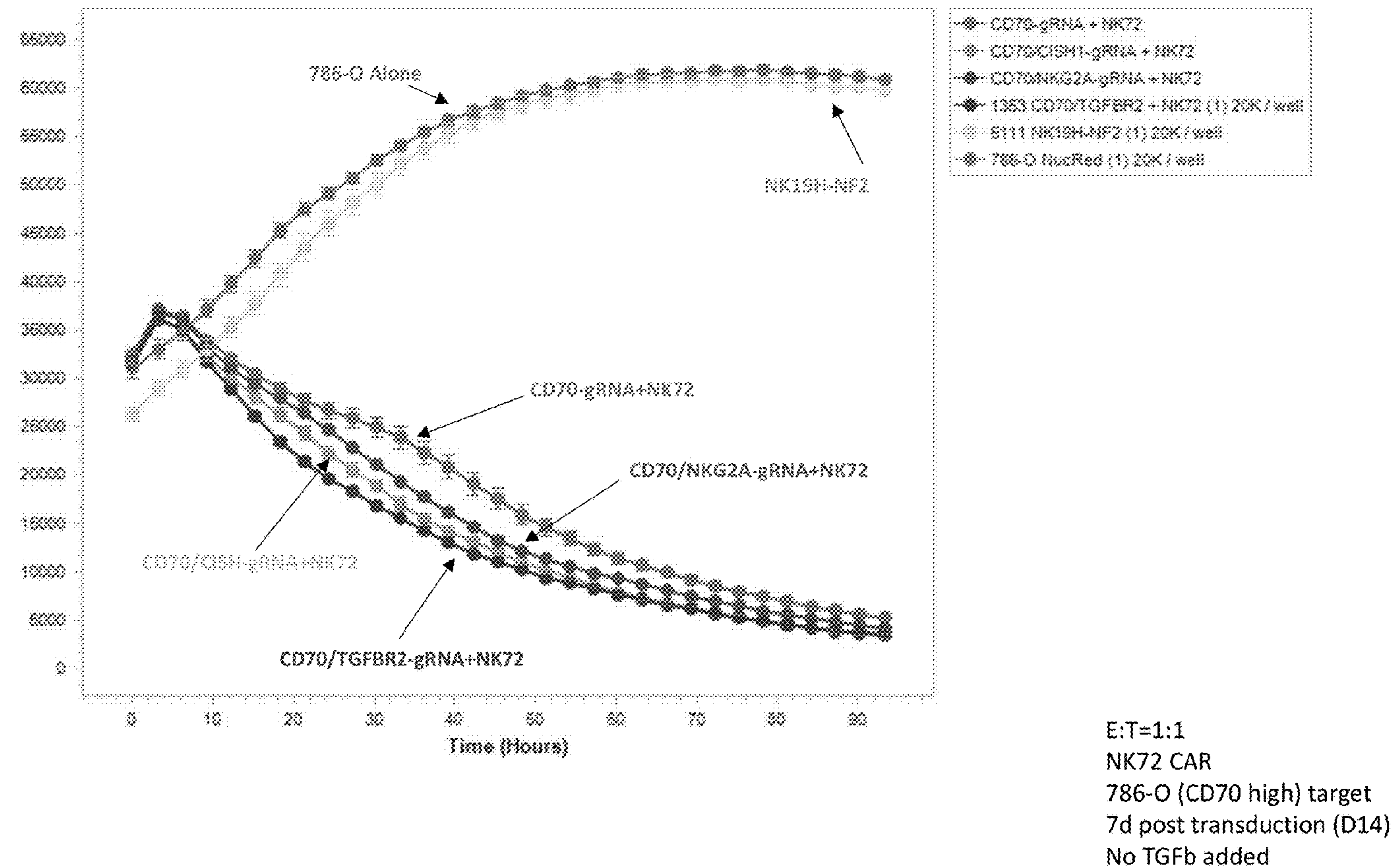

FIGS. 35A-35D show data related to cytotoxicity of NK cells expressing an anti-CD70 CAR and subjected to knockout of various NK cell modulating targets. FIG. 35A shows the cytotoxic effects of engineered NK cells expressing the non-limiting NK71 anti-CD70 CAR against 786-O cells, which express high levels of CD70, at an E:T ratio of 1:1. FIG. 35B shows the cytotoxic effects of engineered NK cells expressing the non-limiting NK71 anti-CD70 CAR against 786-O cells at an E:T ratio of 1:2. FIG. 35C shows the cytotoxic effects of engineered NK cells expressing the non-limiting NK72 anti-CD70 CAR against 786-O cells at an E:T ratio of 1:1. FIG. 35B shows the cytotoxic effects of engineered NK cells expressing the non-limiting NK72 anti-CD70 CAR against 786-O cells at an E:T ratio of 1:2. Data were collected at 7-days post-transduction.

Figure 36A:
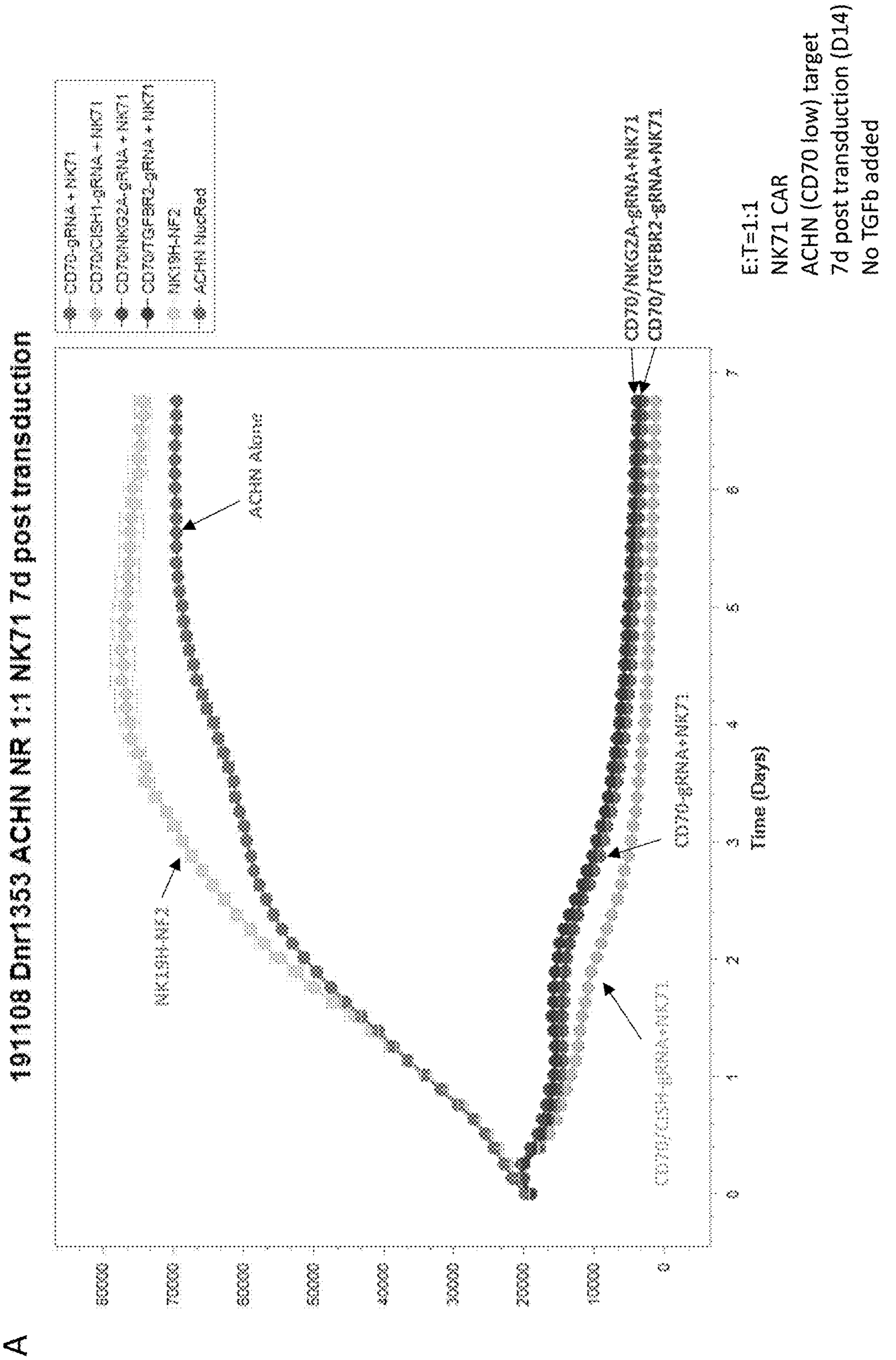
Figure 36B:
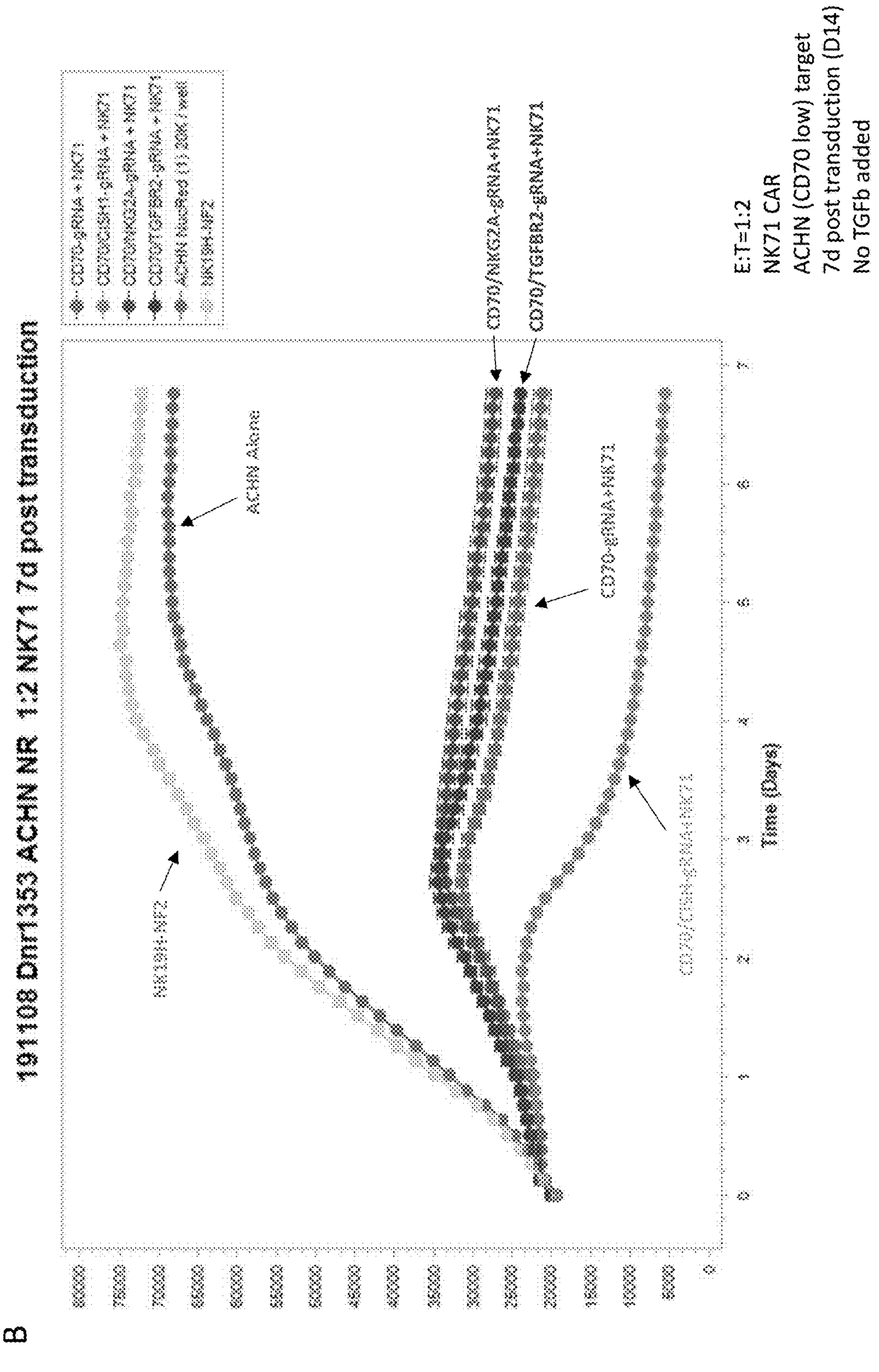
Figure 36C:
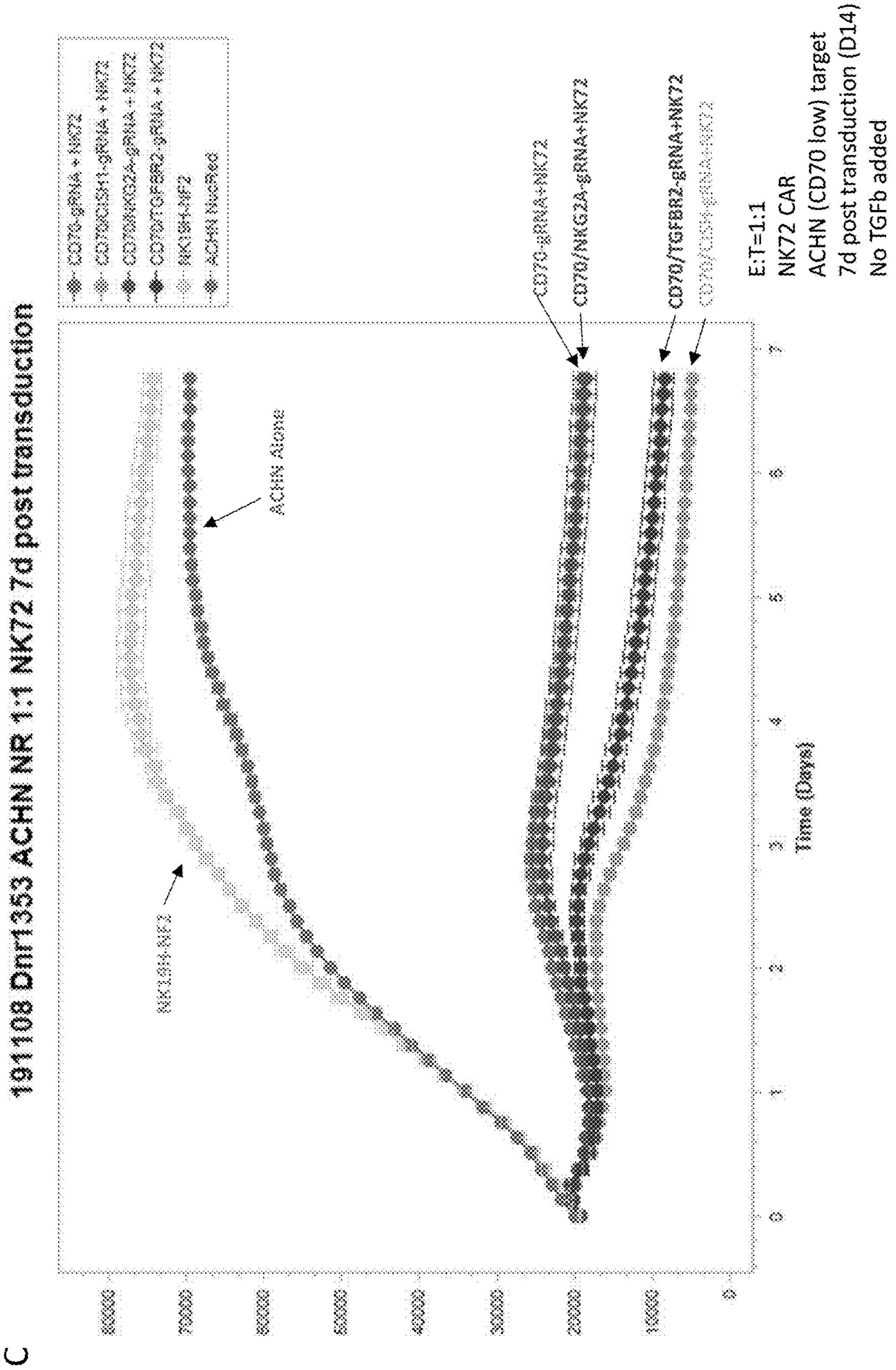
Figure 36D:
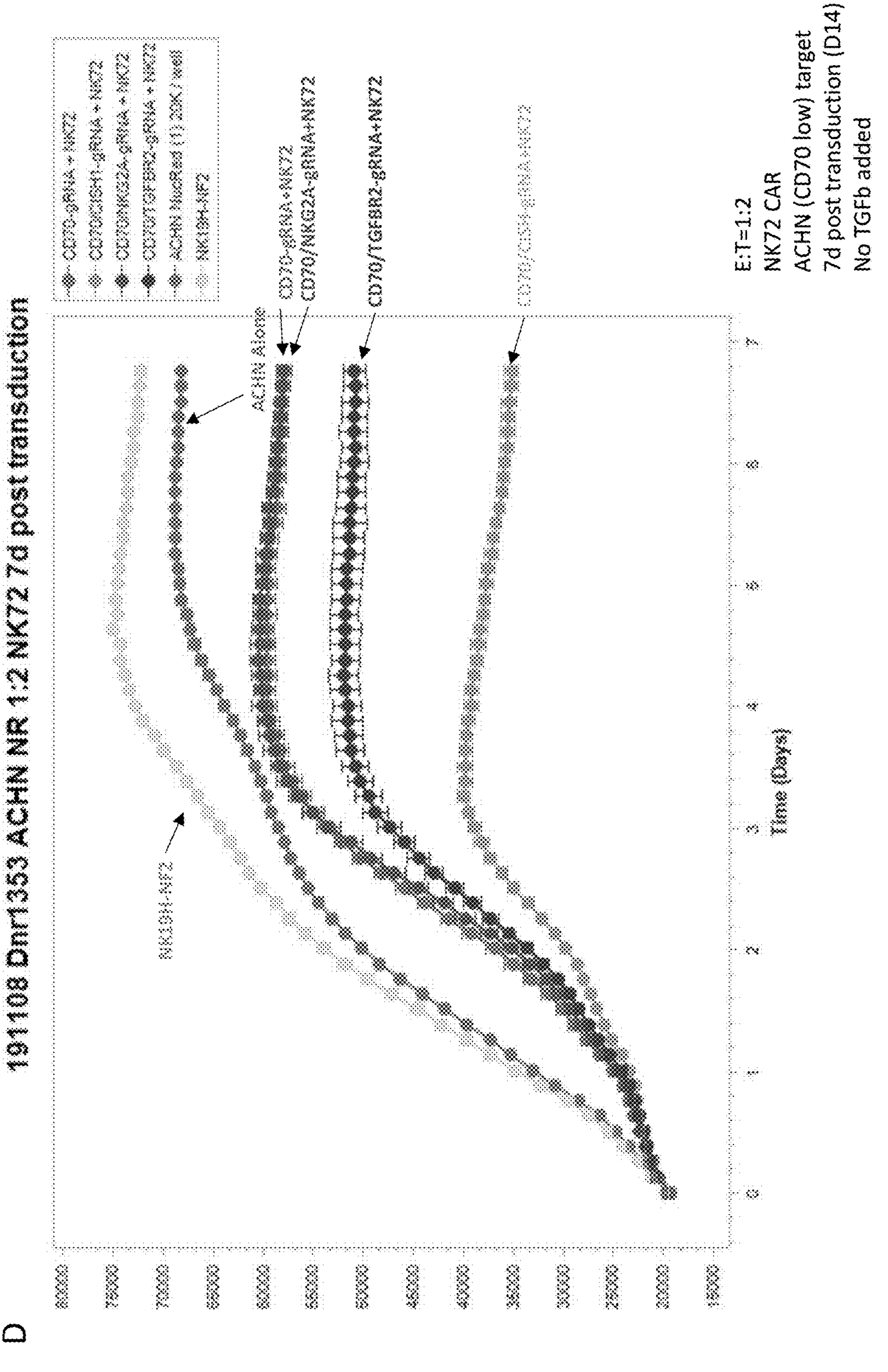

FIGS. 36A-36D show data related to cytotoxicity of NK cells expressing an anti-CD70 CAR and subjected to knockout of various NK cell modulating targets. FIG. 36A shows the cytotoxic effects of engineered NK cells expressing the non-limiting NK71 anti-CD70 CAR against ACHN cells, which express low levels of CD70, at an E:T ratio of 1:1. FIG. 36B shows the cytotoxic effects of engineered NK cells expressing the non-limiting NK71 anti-CD70 CAR against ACHN cells at an E:T ratio of 1:2. FIG. 36C shows the cytotoxic effects of engineered NK cells expressing the non-limiting NK72 anti-CD70 CAR against ACHN cells at an E:T ratio of 1:1. FIG. 36D shows the cytotoxic effects of engineered NK cells expressing the non-limiting NK72 anti-CD70 CAR against ACHN cells at an E:T ratio of 1:2. Data were collected at 7-days post-transduction.

Figure 37A:
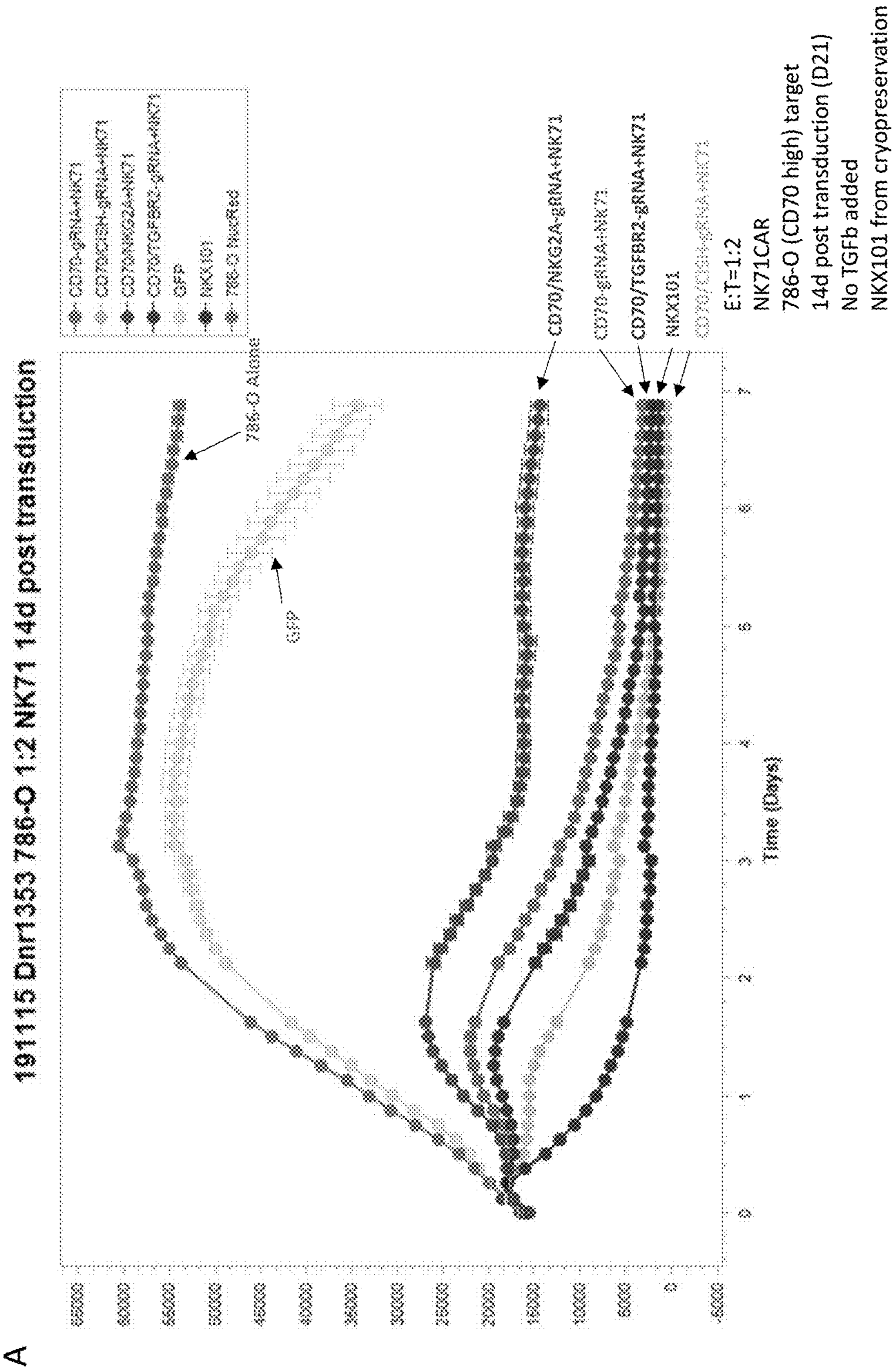
Figure 37B:
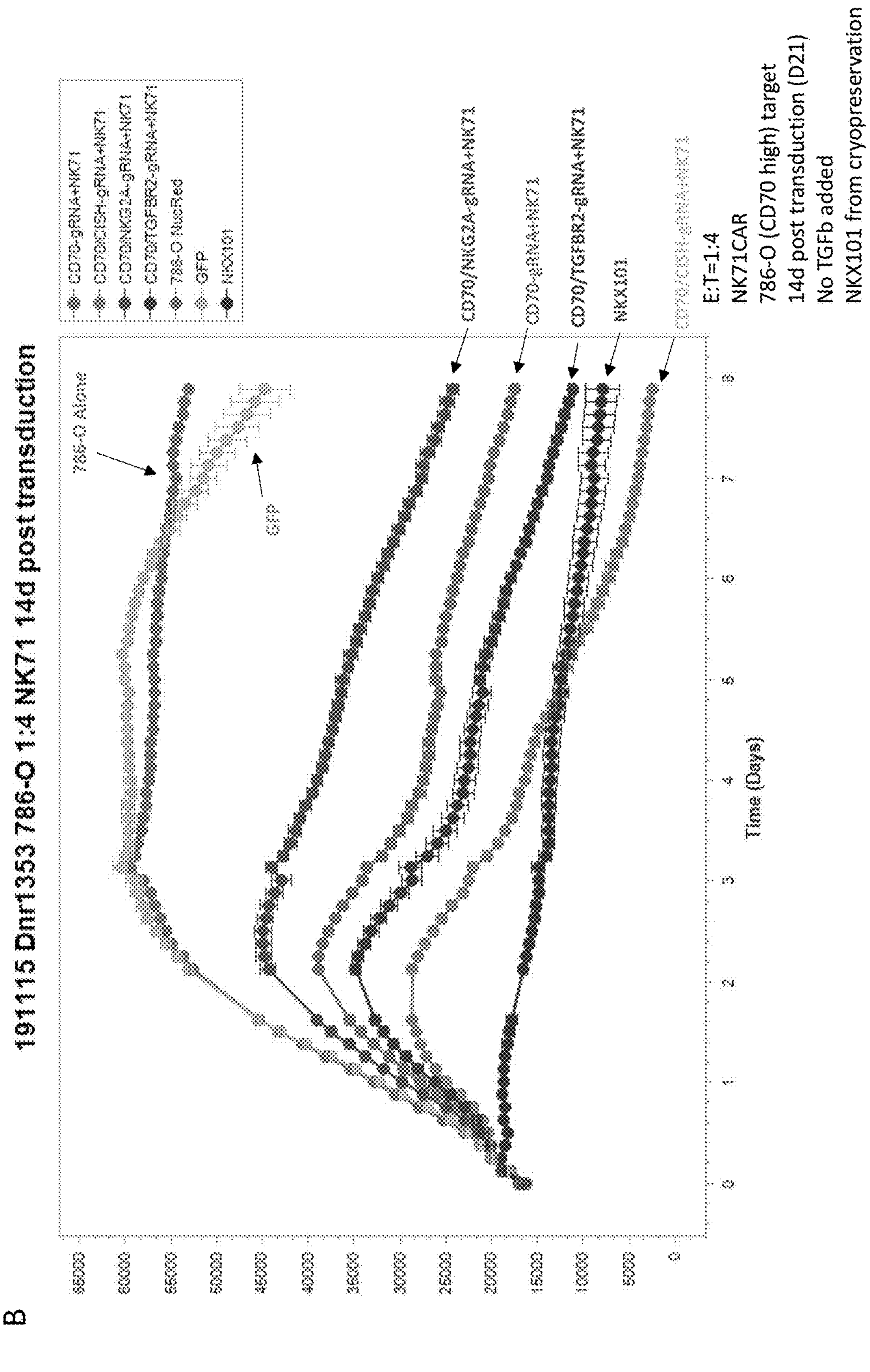

FIGS. 37A-37B show data related to cytotoxicity of NK cells expressing an anti-CD70 CAR and subjected to knockout of various NK cell modulating targets. FIG. 37A shows the cytotoxic effects of engineered NK cells expressing the non-limiting NK71 anti-CD70 CAR against 786-O cells, which express high levels of CD70, at an E:T ratio of 1:2. FIG. 37B shows the cytotoxic effects of engineered NK cells expressing the non-limiting NK71 anti-CD70 CAR against 786-O cells at an E:T ratio of 1:4. Data were collected at 14-days post-transduction.

Figure 38A:
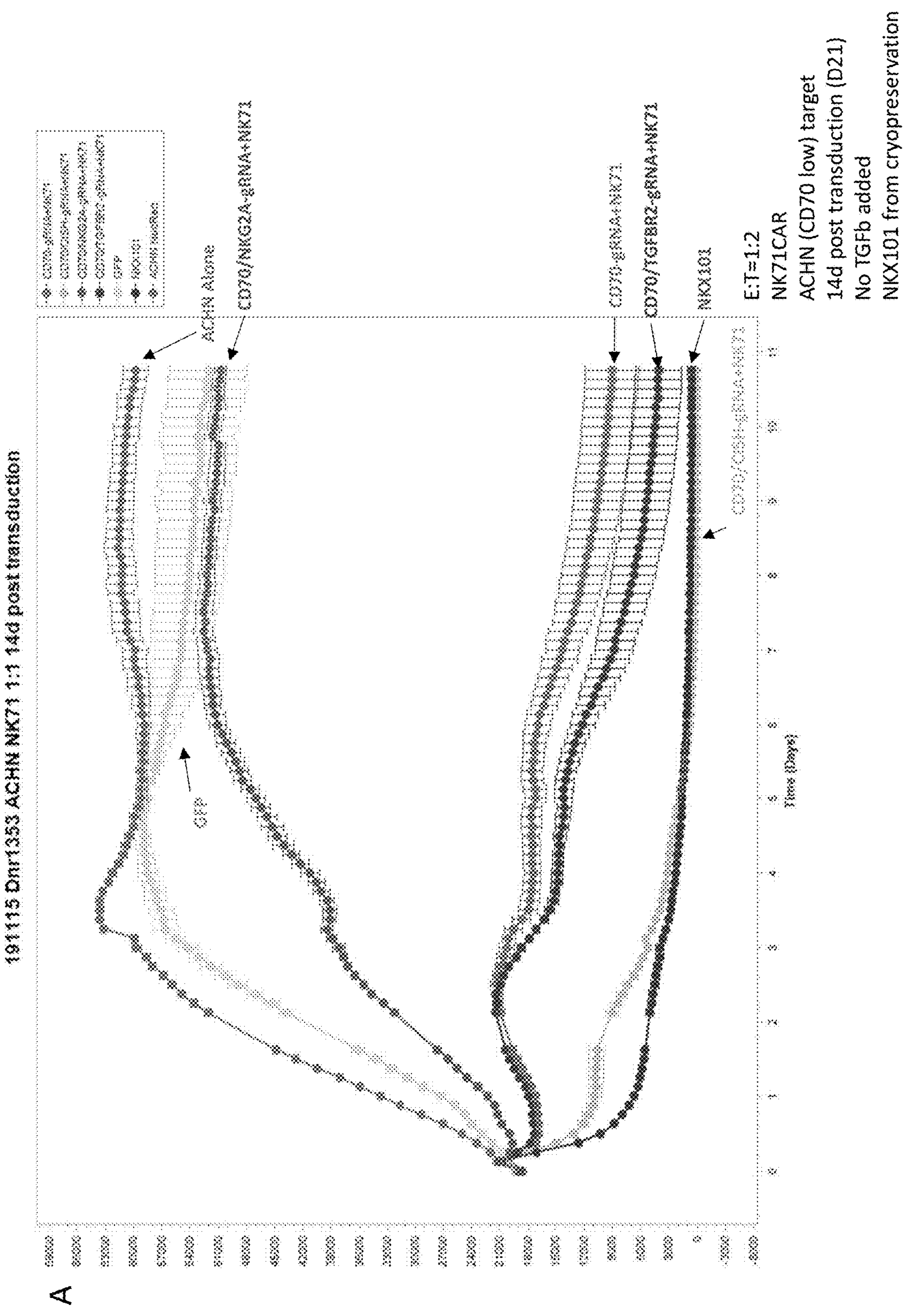
Figure 38B:
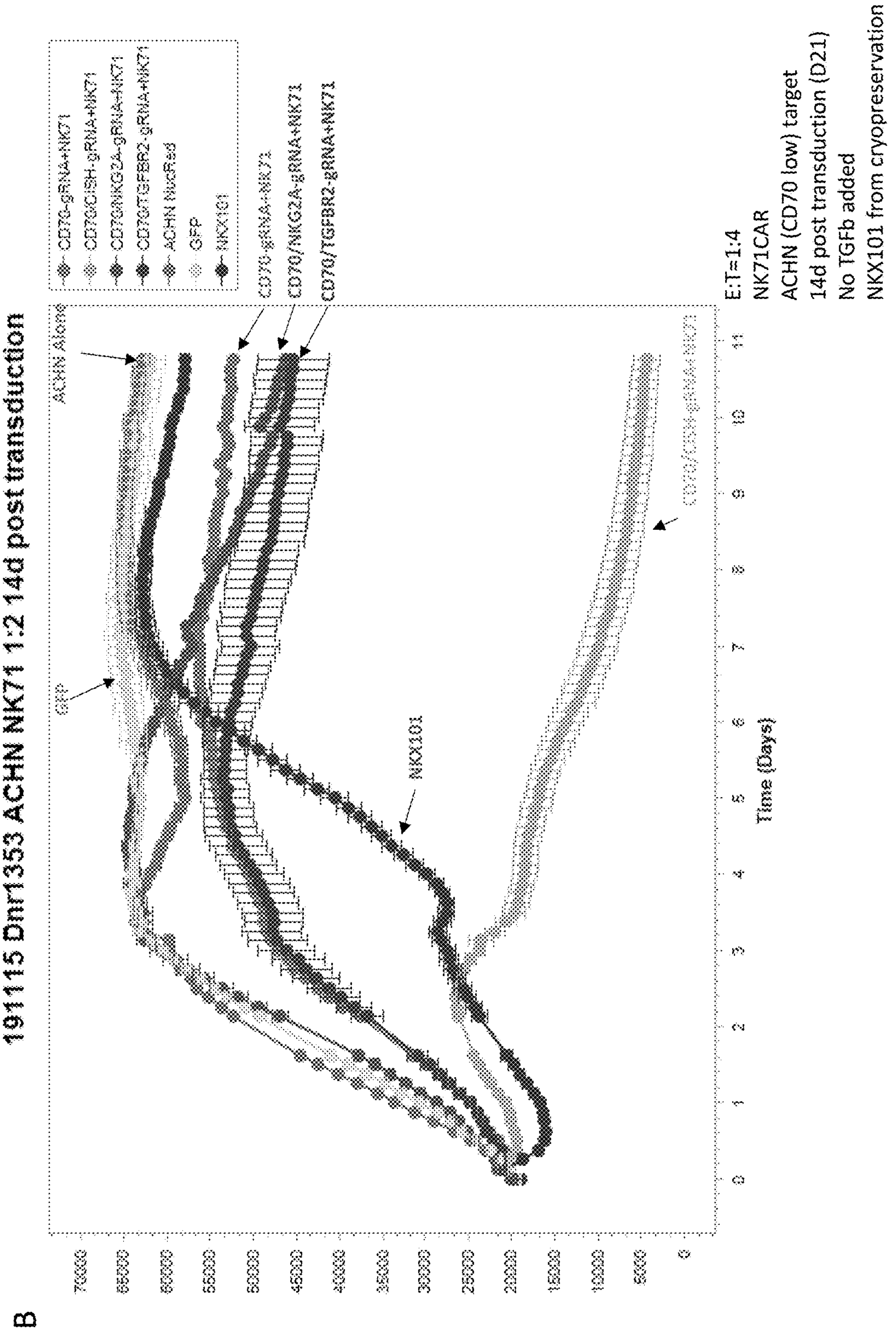

FIGS. 38A-38B show data related to cytotoxicity of NK cells expressing an anti-CD70 CAR and subjected to knockout of various NK cell modulating targets. FIG. 38A shows the cytotoxic effects of engineered NK cells expressing the non-limiting NK71 anti-CD70 CAR against ACHN cells, which express low levels of CD70, at an E:T ratio of 1:1. FIG. 38B shows the cytotoxic effects of engineered NK cells expressing the non-limiting NK71 anti-CD70 CAR against ACHN cells at an E:T ratio of 1:2. Data were collected at 14-days post-transduction.

Figure 39A:
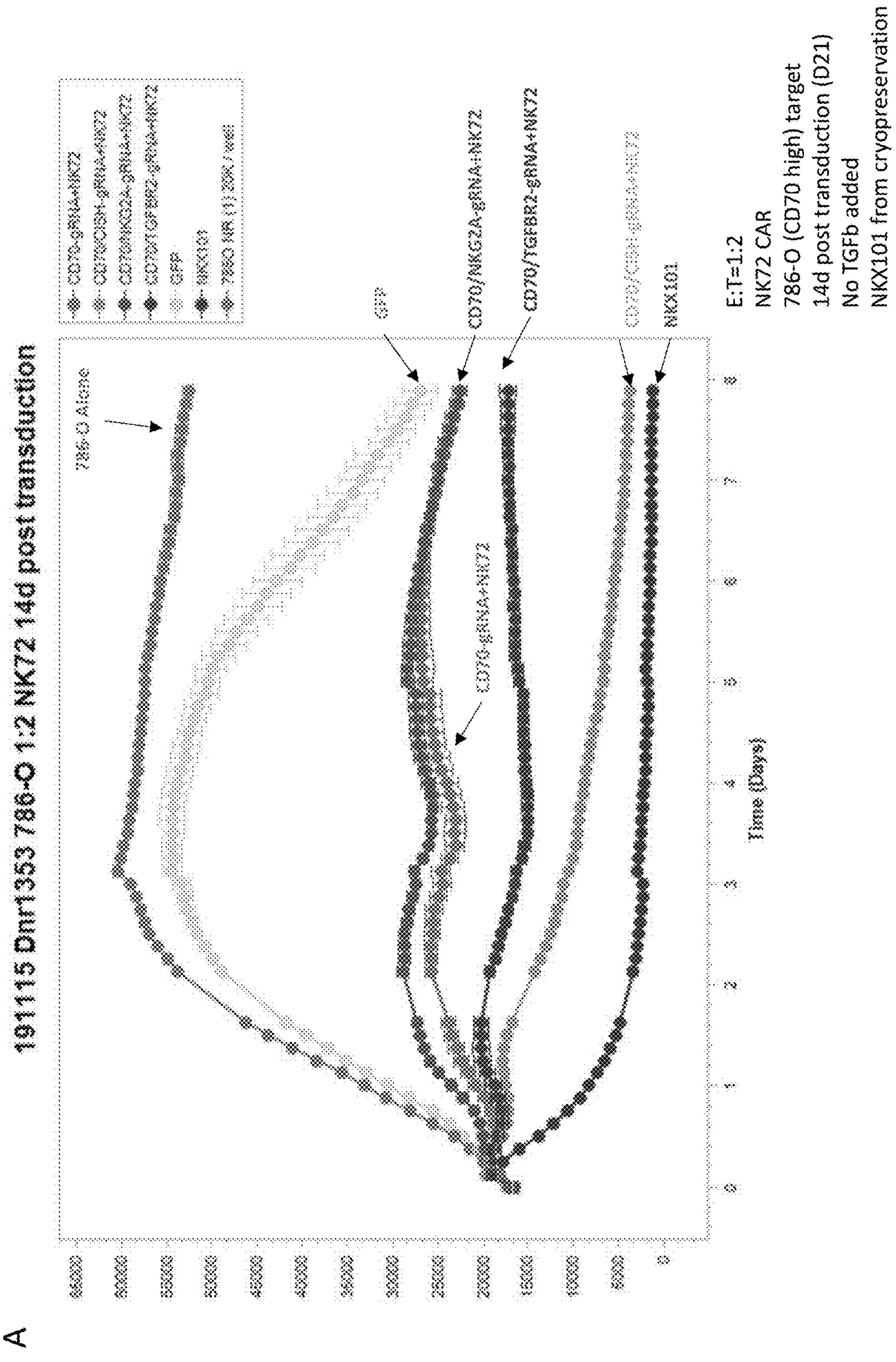
Figure 39B:
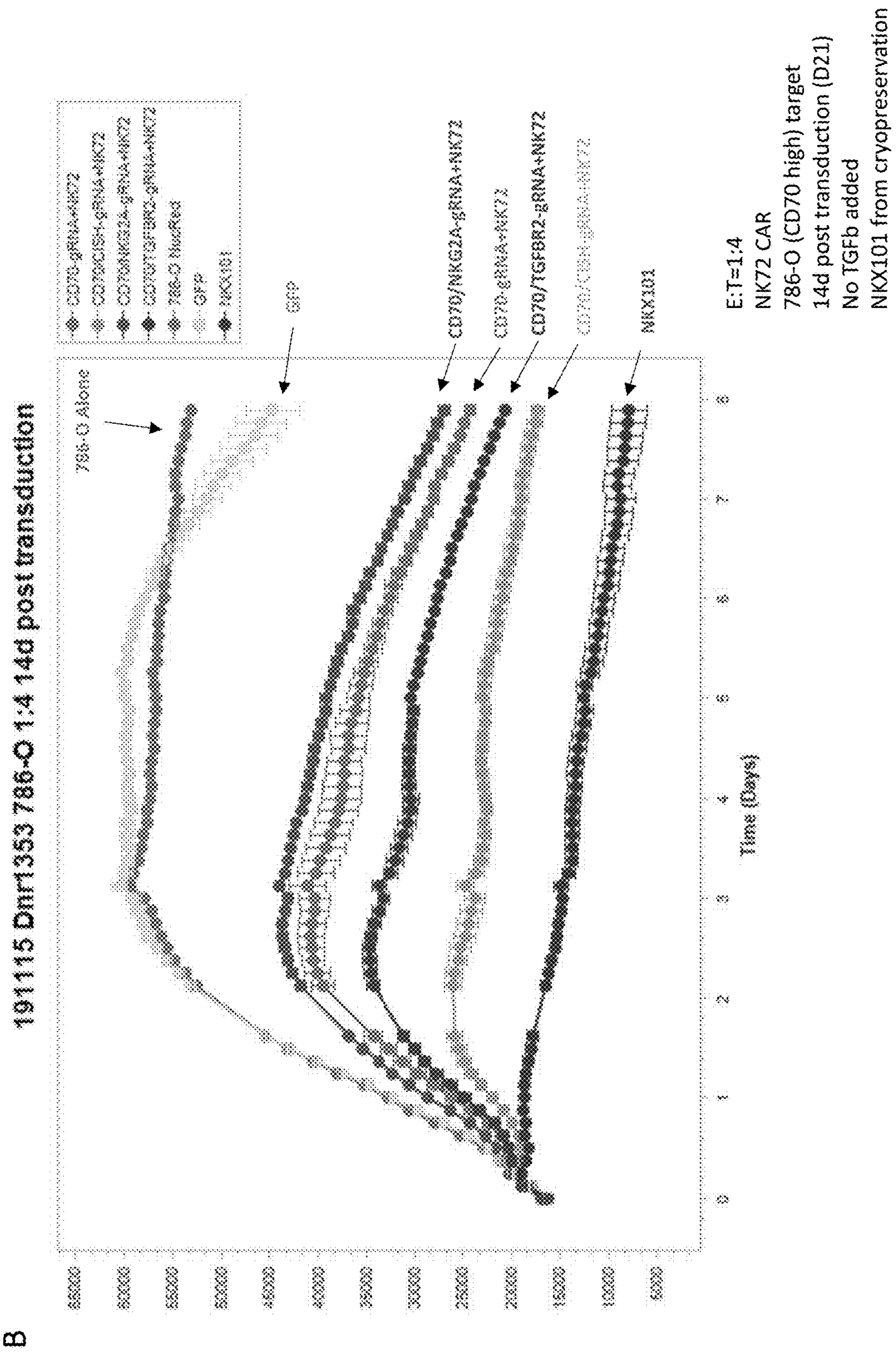

FIGS. 39A-39B show data related to cytotoxicity of NK cells expressing an anti-CD70 CAR and subjected to knockout of various NK cell modulating targets. FIG. 39A shows the cytotoxic effects of engineered NK cells expressing the non-limiting NK72 anti-CD70 CAR against 786-O cells, which express high levels of CD70, at an E:T ratio of 1:2. FIG. 39B shows the cytotoxic effects of engineered NK cells expressing the non-limiting NK72 anti-CD70 CAR against 786-O cells at an E:T ratio of 1:4. Data were collected at 14-days post-transduction.

Figure 40A:
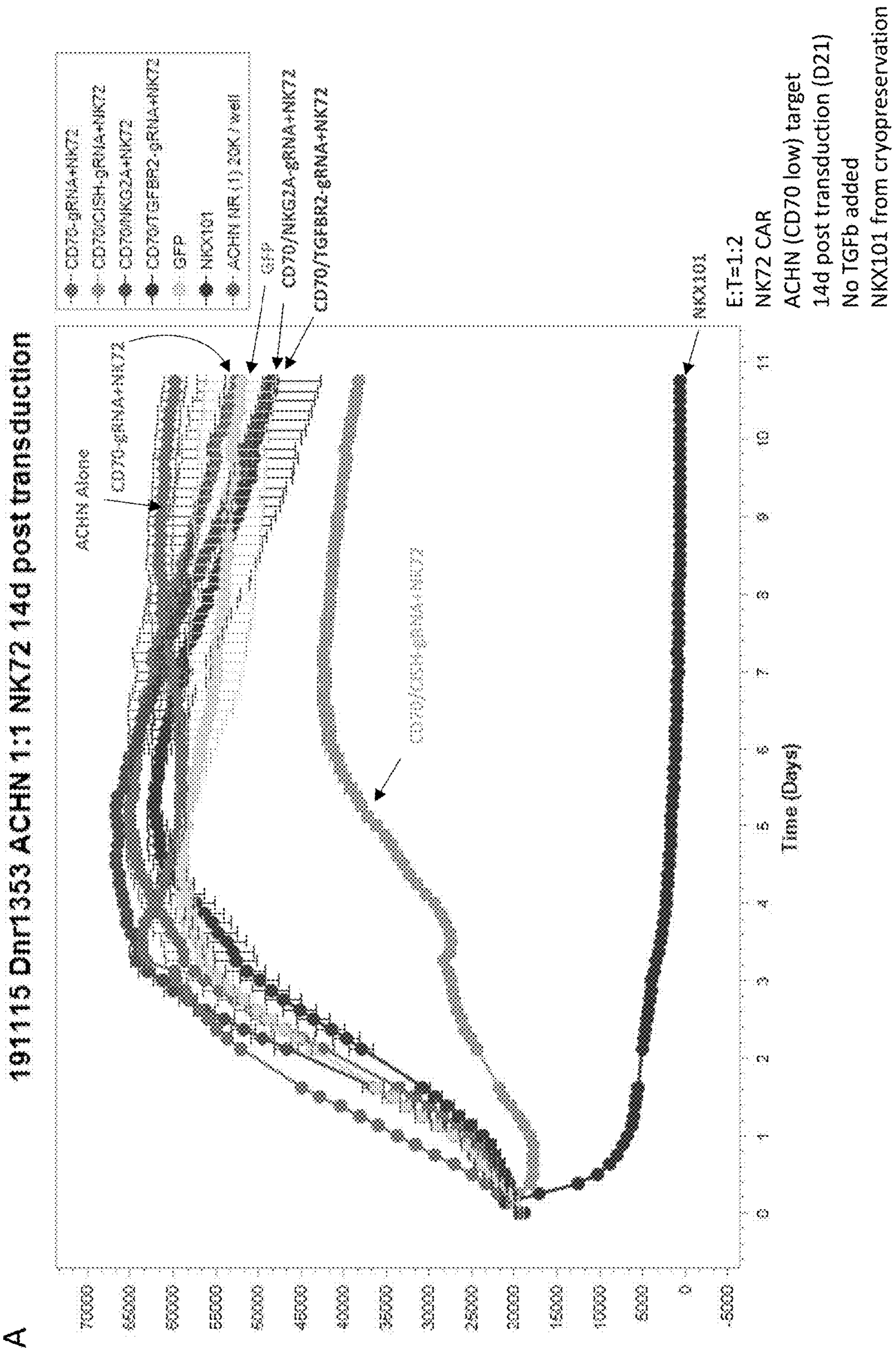
Figure 40B:
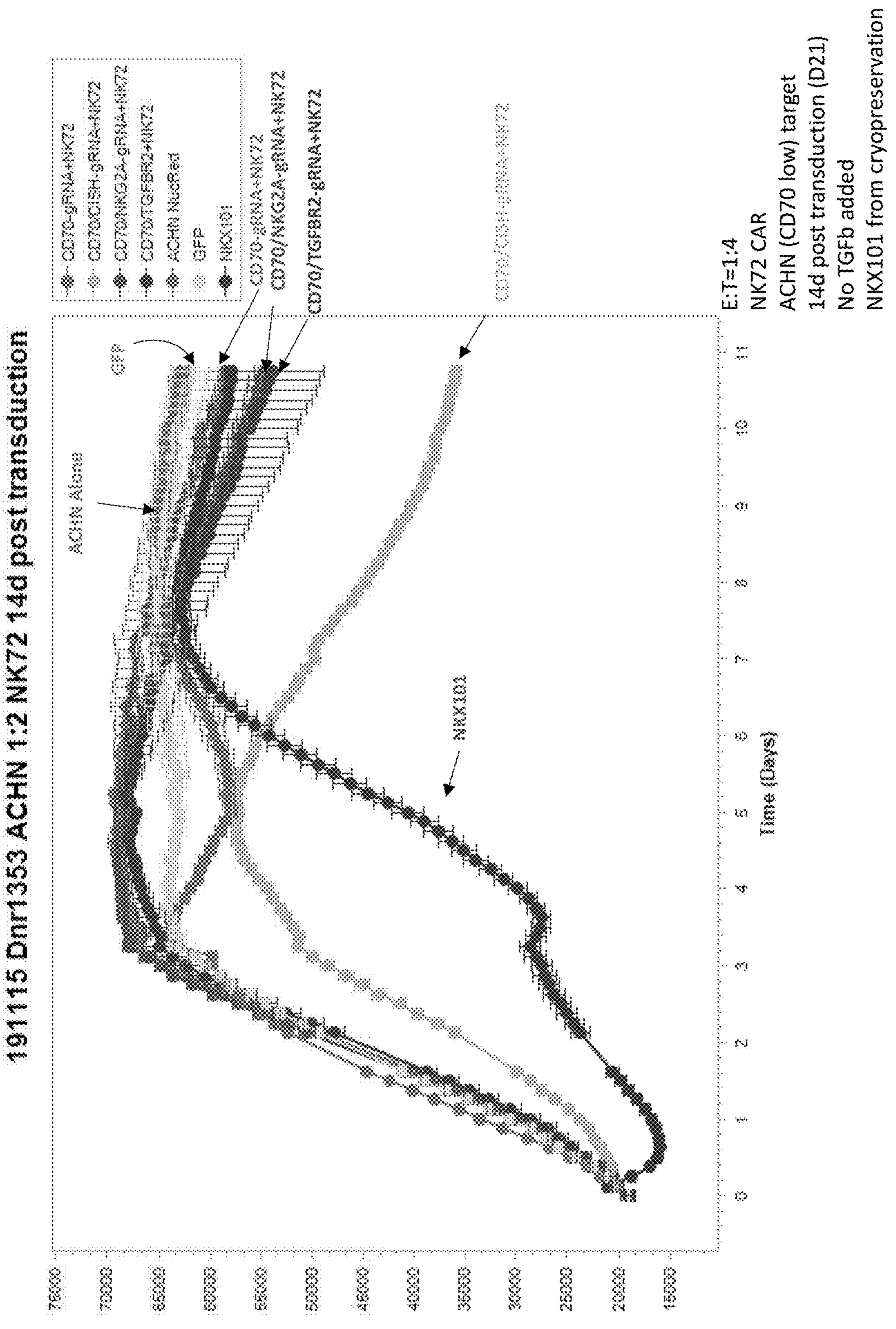

FIGS. 40A-40B show data related to cytotoxicity of NK cells expressing an anti-CD70 CAR and subjected to knockout of various NK cell modulating targets. FIG. 40A shows the cytotoxic effects of engineered NK cells expressing the non-limiting NK72 anti-CD70 CAR against ACHN cells, which express low levels of CD70, at an E:T ratio of 1:1. FIG. 40B shows the cytotoxic effects of engineered NK cells expressing the non-limiting NK71 anti-CD70 CAR against ACHN cells at an E:T ratio of 1:2. Data were collected at 14-days post-transduction.

Figure 41D:
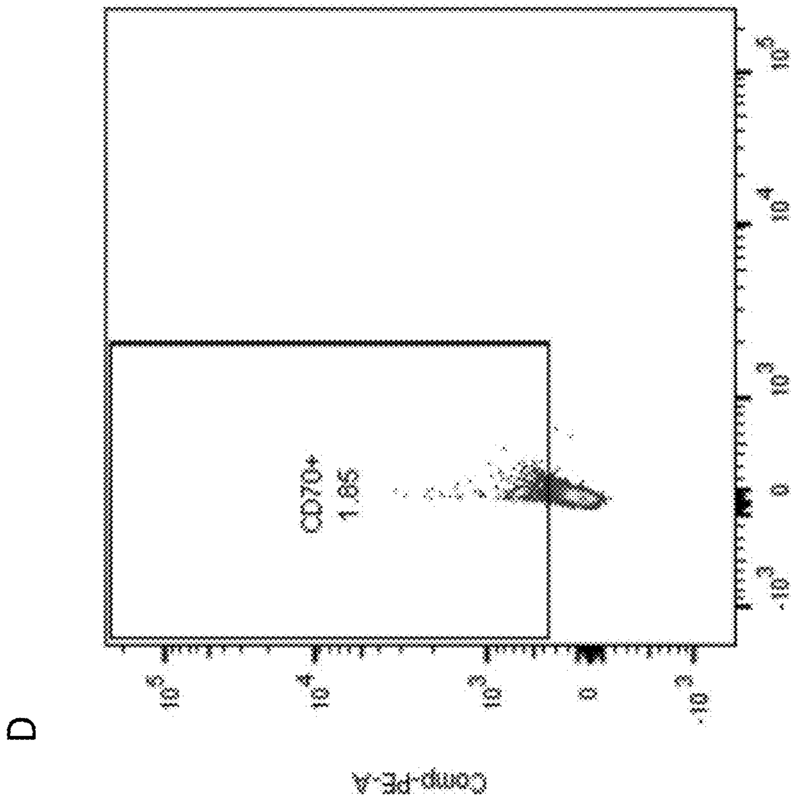
Figure 41E:
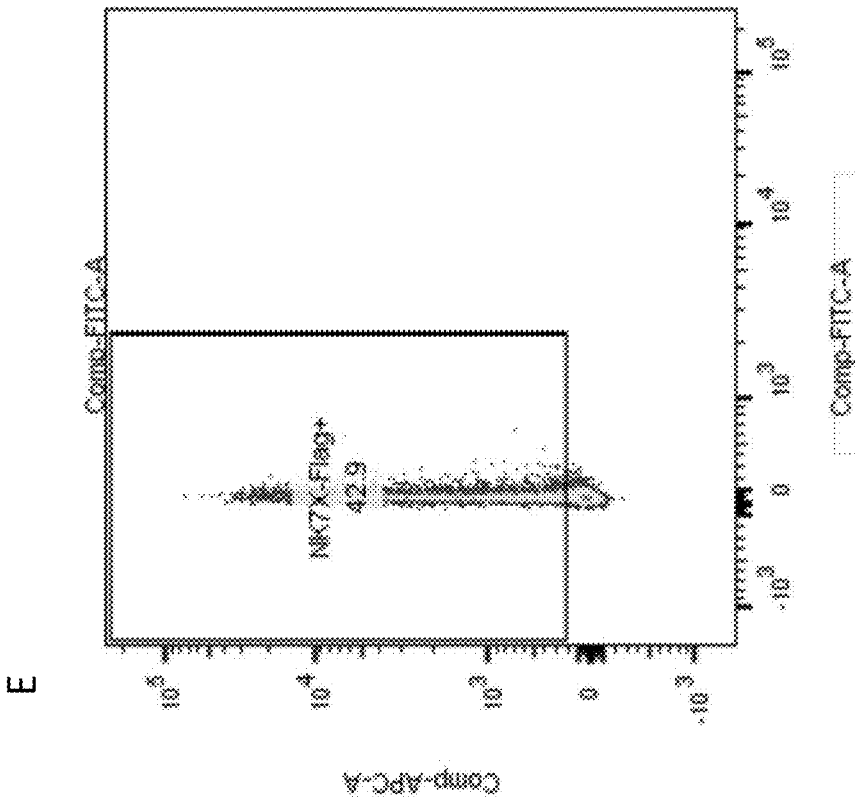
Figure 41F:
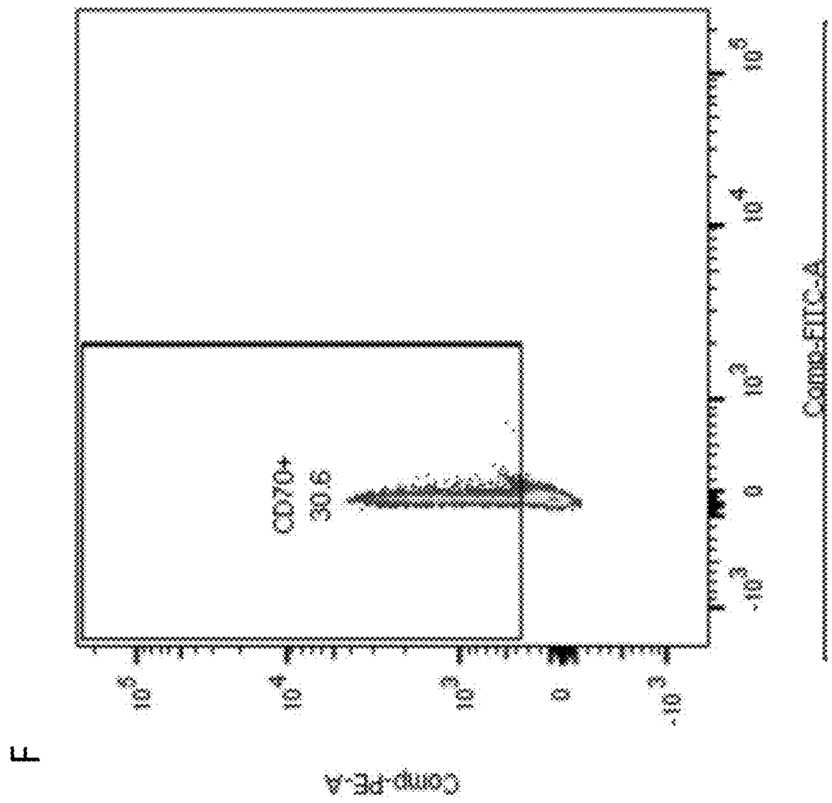
Figure 41G:
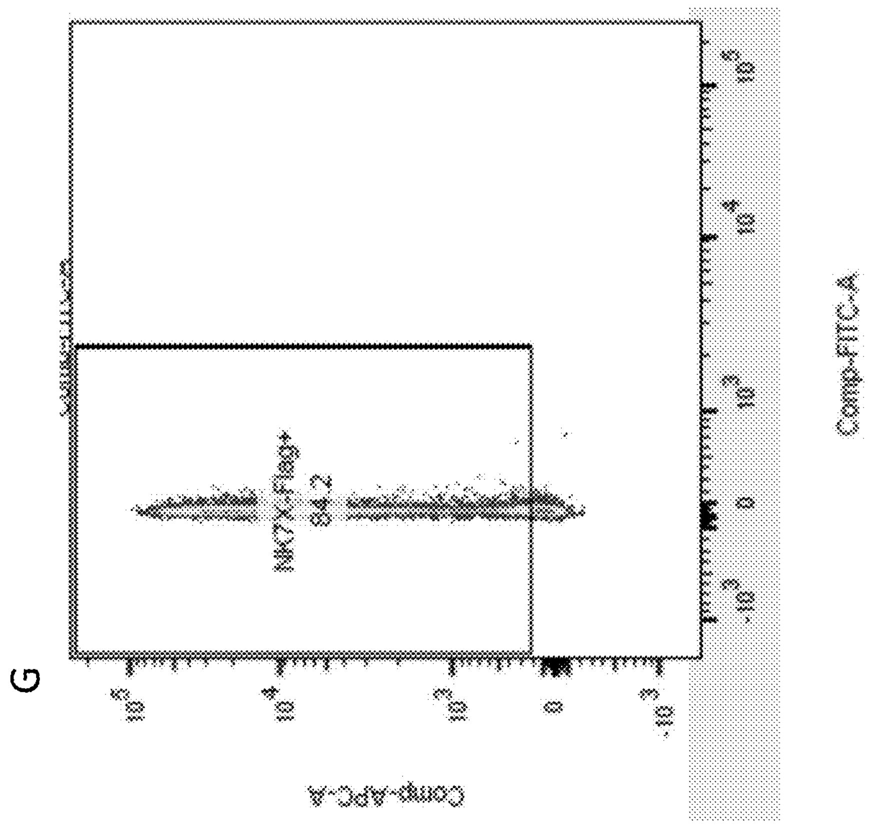
Figure 41I:
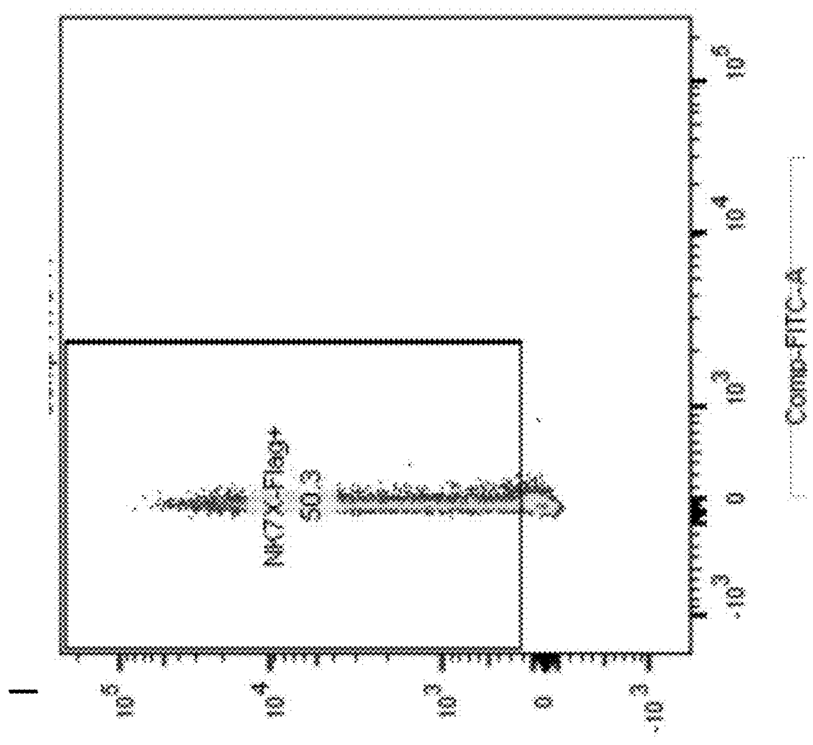
Figure 41H:
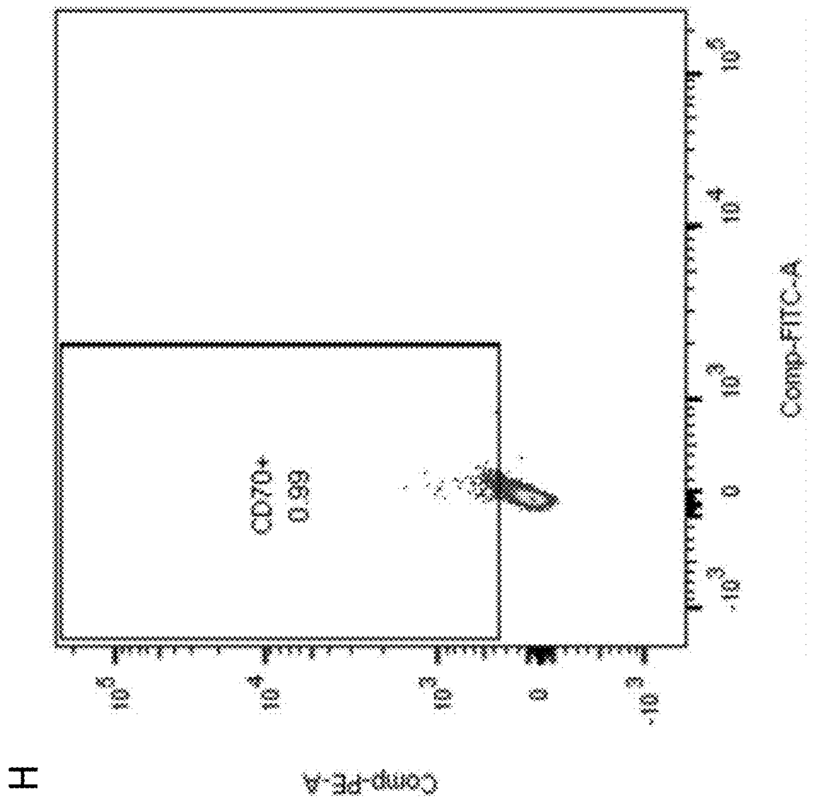
Figure 41K:
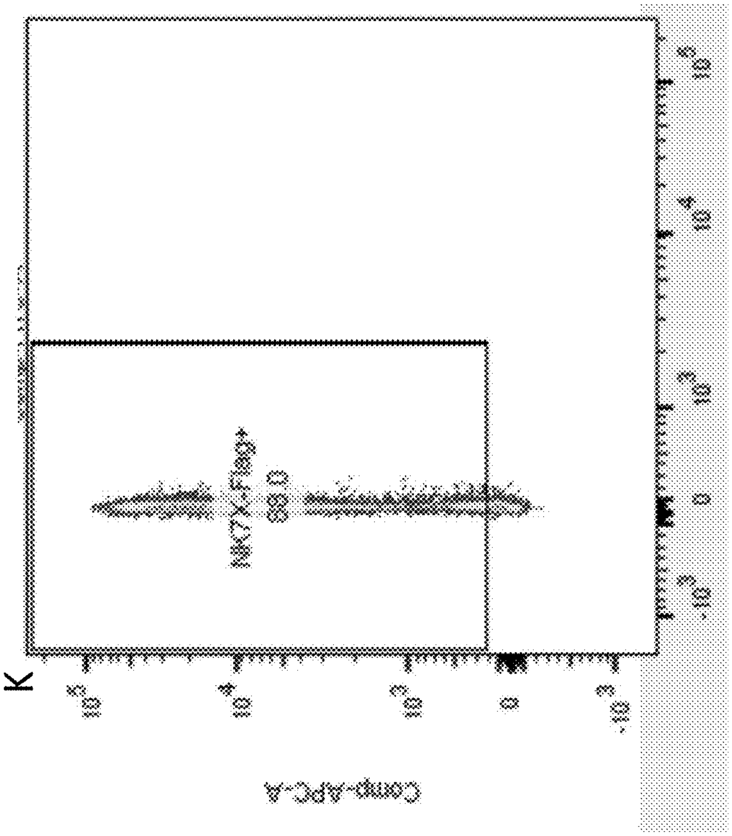
Figure 41J:
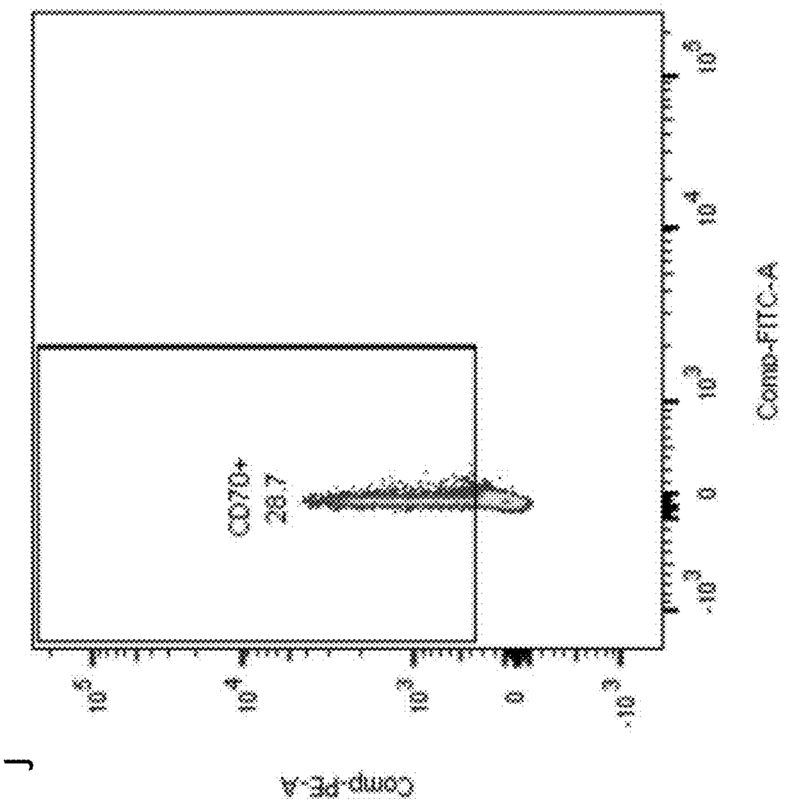
Figure 41M:
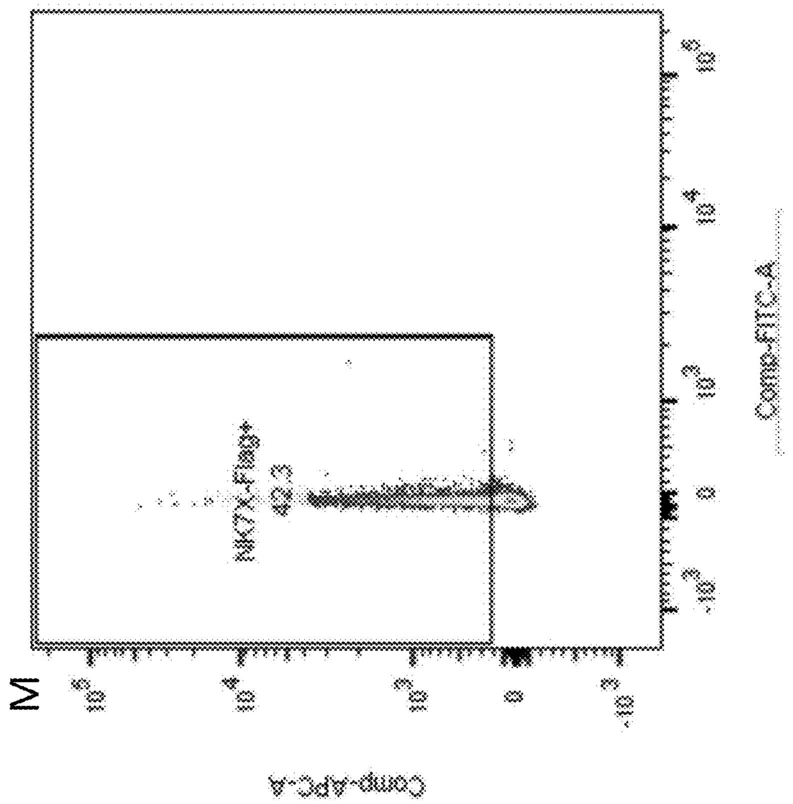
Figure 41L:
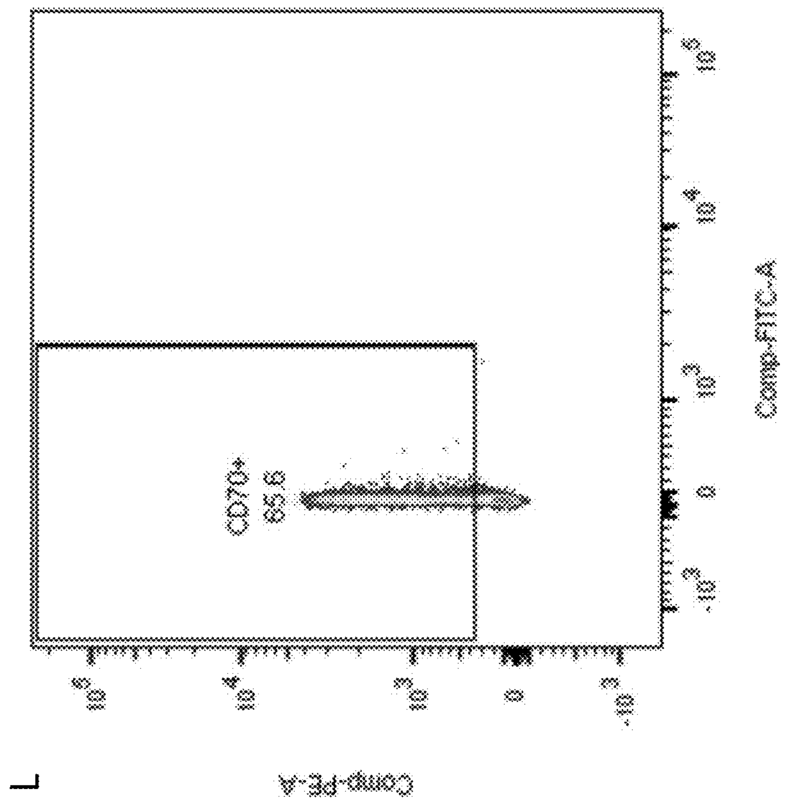
Figure 41N:
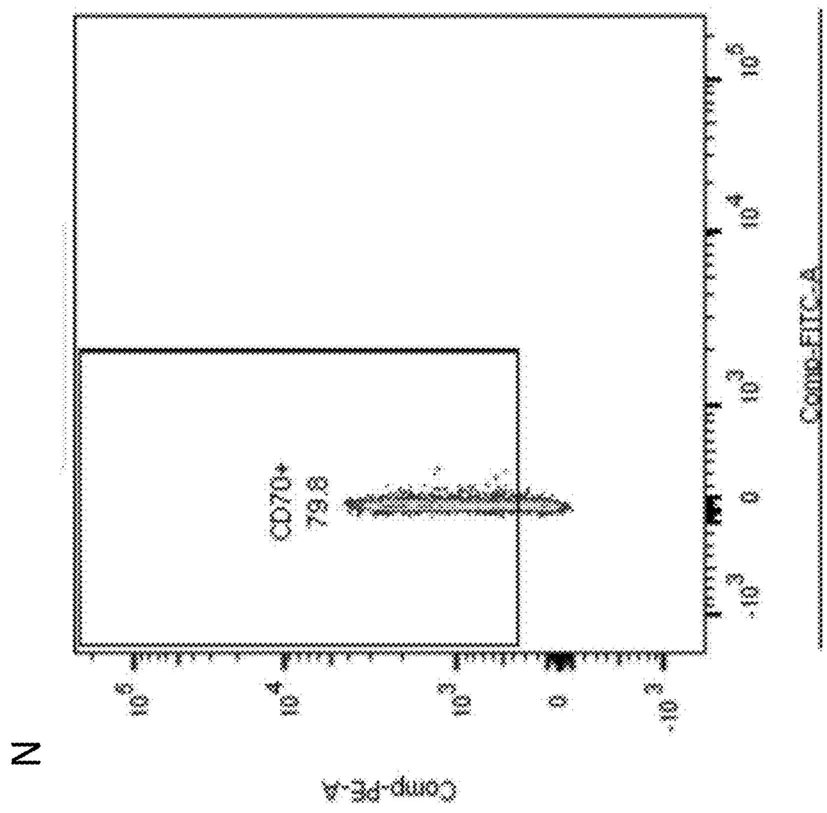
Figure 41O:
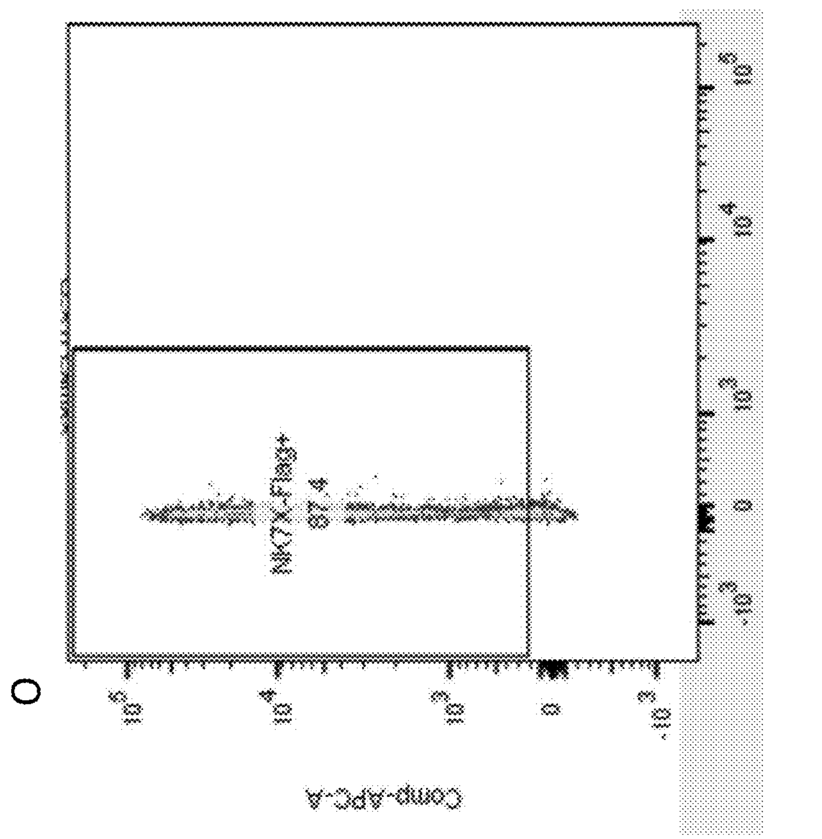

FIGS. 41A-41O relate to gene editing protocol and evaluation of the expression of the various editing targets as well as expression of an anti-CD70 CAR. FIG. 41A shows a non-limiting embodiment of the gene editing protocol employed. FIG. 41B shows an unstained control (no anti-CD70 antibody) representing background signal. FIG. 41B shows a control where CD70 expression was measured on NK cells transduced with a CAR not targeting CD70 and that does not include a CD70 subunit. This represents baseline NK cell CD70 expression. FIG. 41D shows CD70 expression on NK cells subjected to gene editing to knockout CD70 expression. FIG. 41E shows expression of the non-limiting NK71 anti-CD70 CAR on NK cells with knocked out CD70 expression. FIG. 41F shows CD70 expression on NK cells subjected to gene editing to knockout CD70 expression. FIG. 41G shows expression of the non-limiting NK72 anti-CD70 CAR on NK cells with knocked out CD70 expression. FIG. 41H shows CD70 expression on NK cells subjected to gene editing to knockout CD70 and CISH expression. FIG. 41F shows expression of the non-limiting NK71 anti-CD70 CAR on NK cells with knocked out CD70 and CISH expression. FIG. 41J shows CD70 expression on NK cells subjected to gene editing to knockout CD70 and CISH expression. FIG. 41GK shows expression of the non-limiting NK72 anti-CD70 CAR on NK cells with knocked out CD70 and CISH expression. FIG. 41L shows CD70 expression on NK cells subjected to electroporation only, as a control. FIG. 41M shows expression of the non-limiting NK71 anti-CD70 CAR on NK cells subjected to electroporation only, as a control. FIG. 41N shows CD70 expression on NK cells subjected to electroporation only, as a control. FIG. 41O shows expression of the non-limiting NK72 anti-CD70 CAR on NK cells subjected to electroporation only, as a control.

Figure 42A:
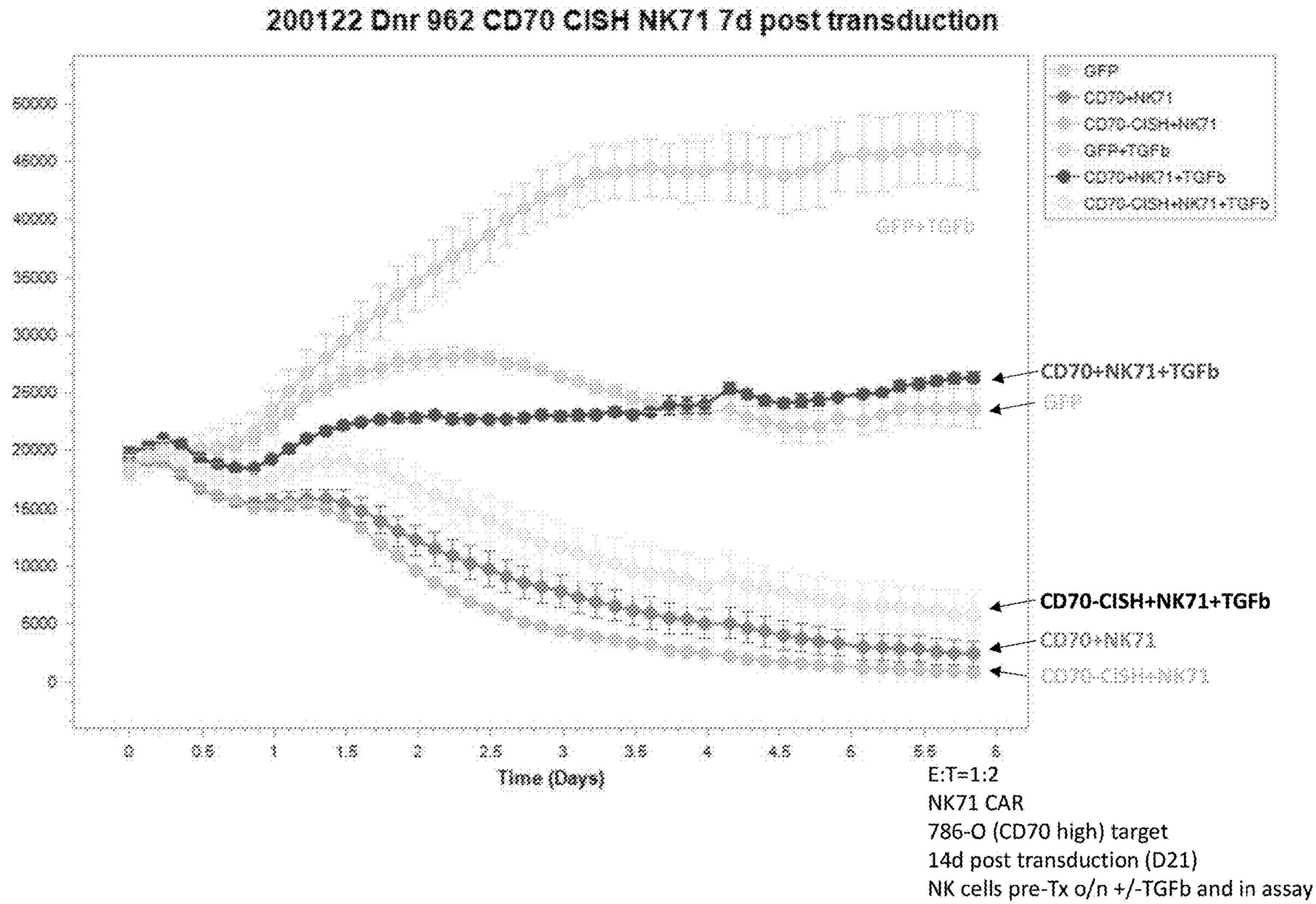
Figure 42B:
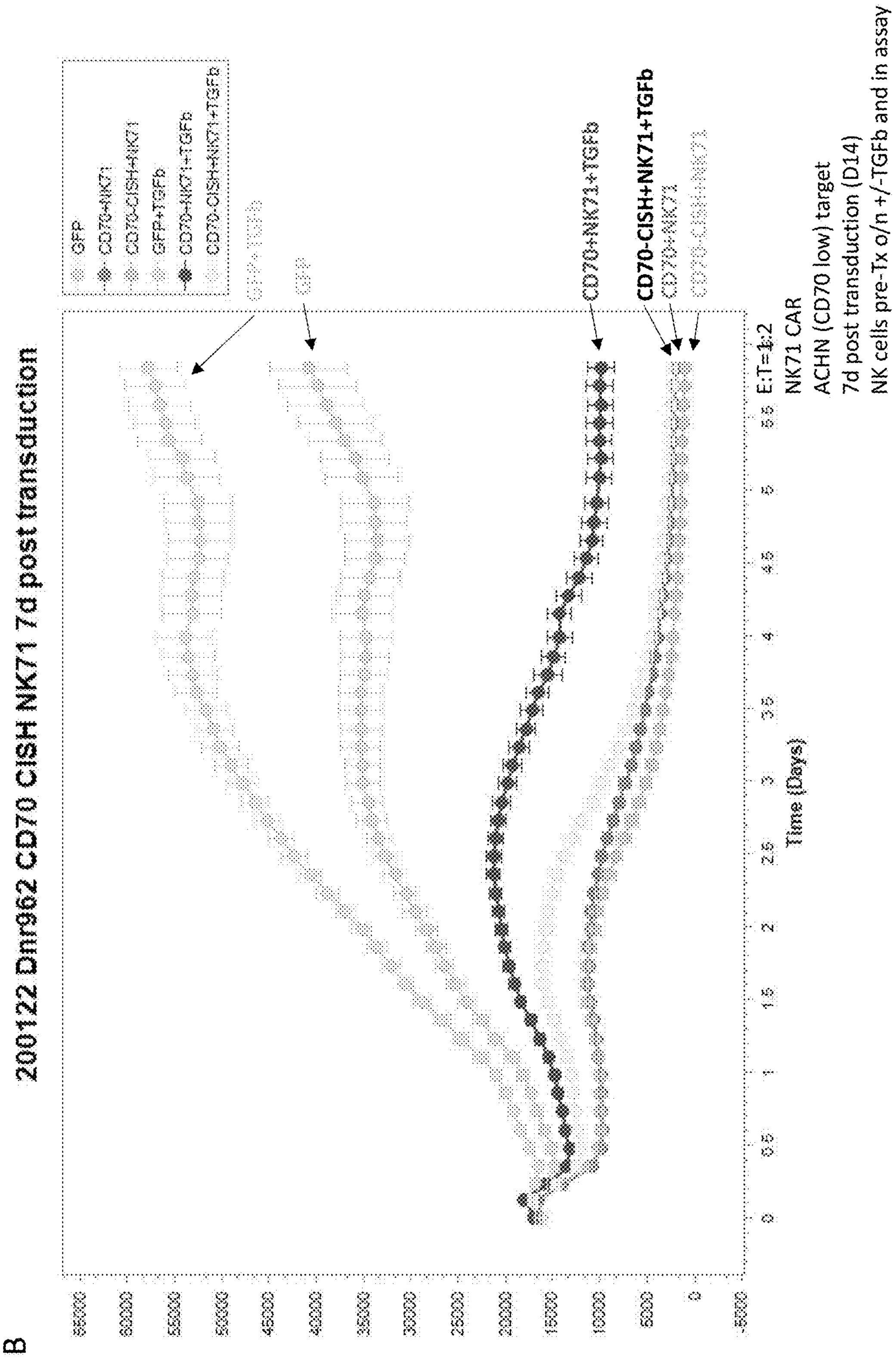
Figure 42C:
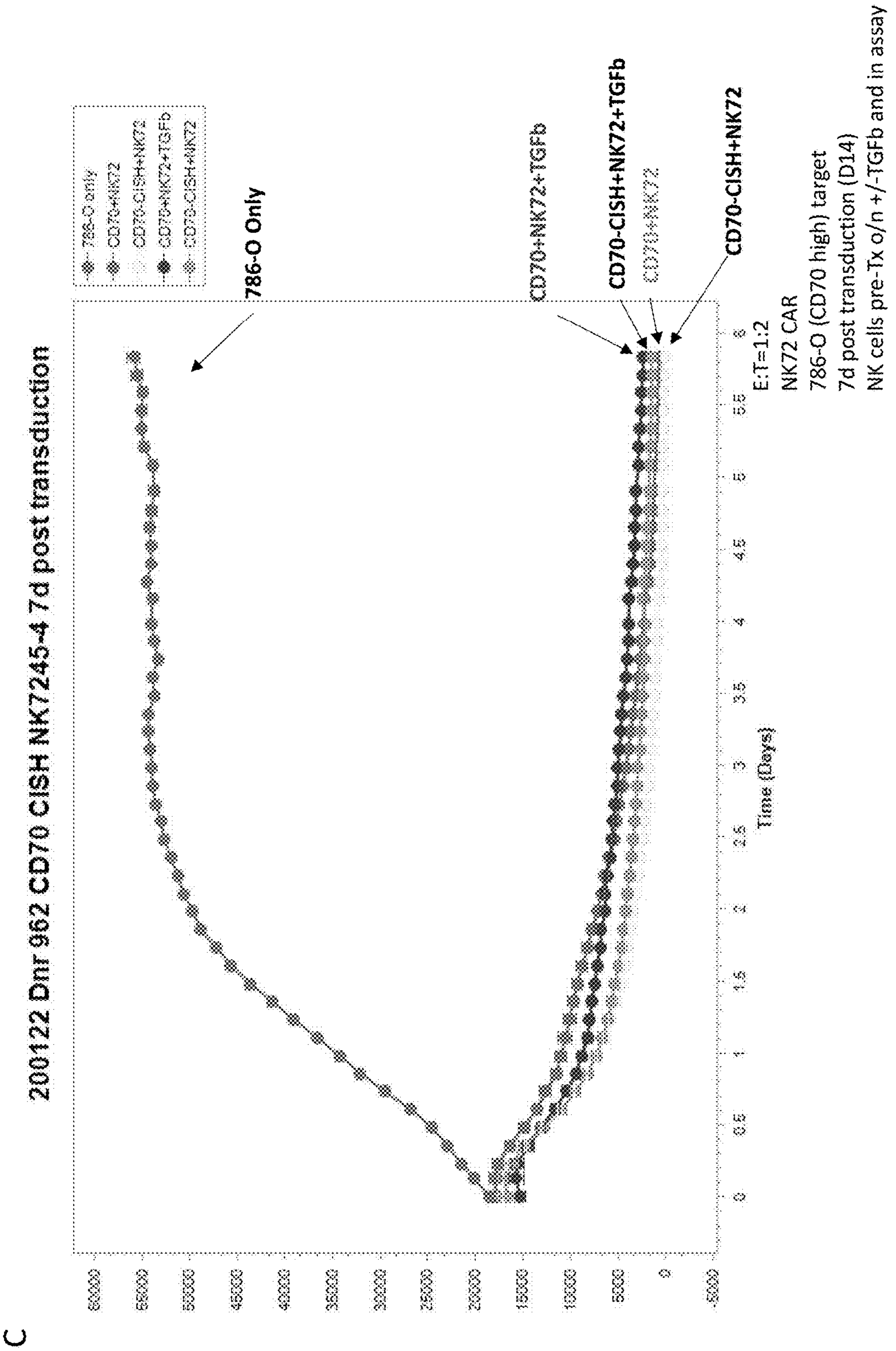

FIGS. 42A-42C relate to cytotoxicity data for NK cells subjected to gene editing and engineered to express an anti-CD70 CAR. FIG. 42A shows cytotoxicity of the NK cells treated in the indicated manner against 786-O cells, which express high levels of CD70, evaluated at 7 days post-transduction and at an E:T ratio of 1:2. FIG. 42B shows cytotoxicity of the NK cells treated in the indicated manner against ACHN cells, which express low levels of CD70, evaluated at 7 days post-transduction and at an E:T ratio of 1:2. FIG. 42C shows cytotoxicity of the NK cells treated in the indicated manner against 786-O cells, which express high levels of CD70, evaluated at 7 days post-transduction and at an E:T ratio of 1:2.

Figure 43A:
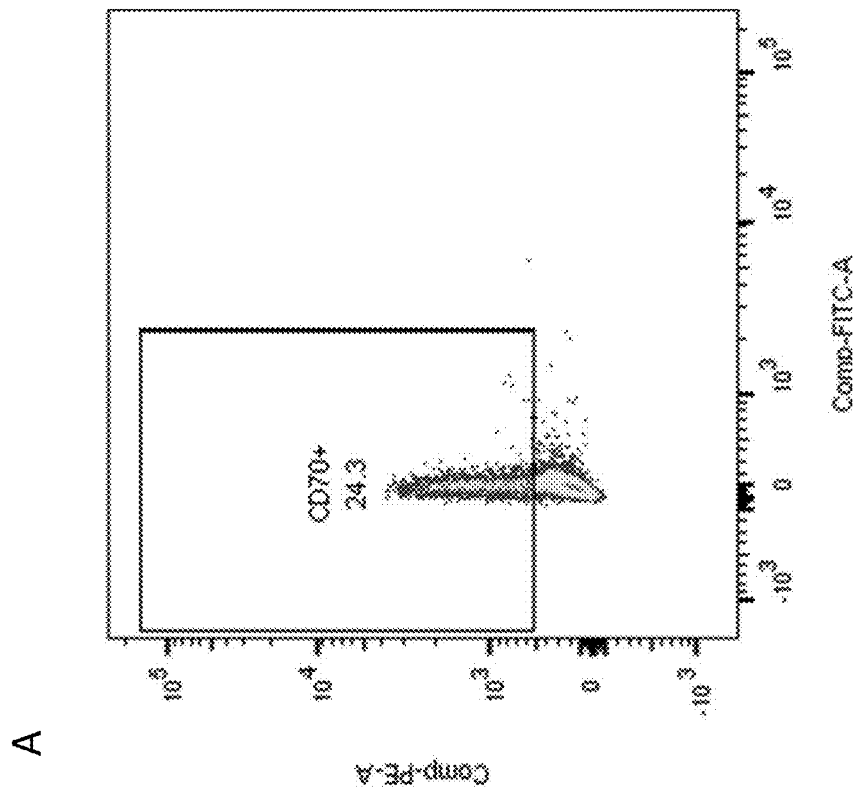
Figure 43B:
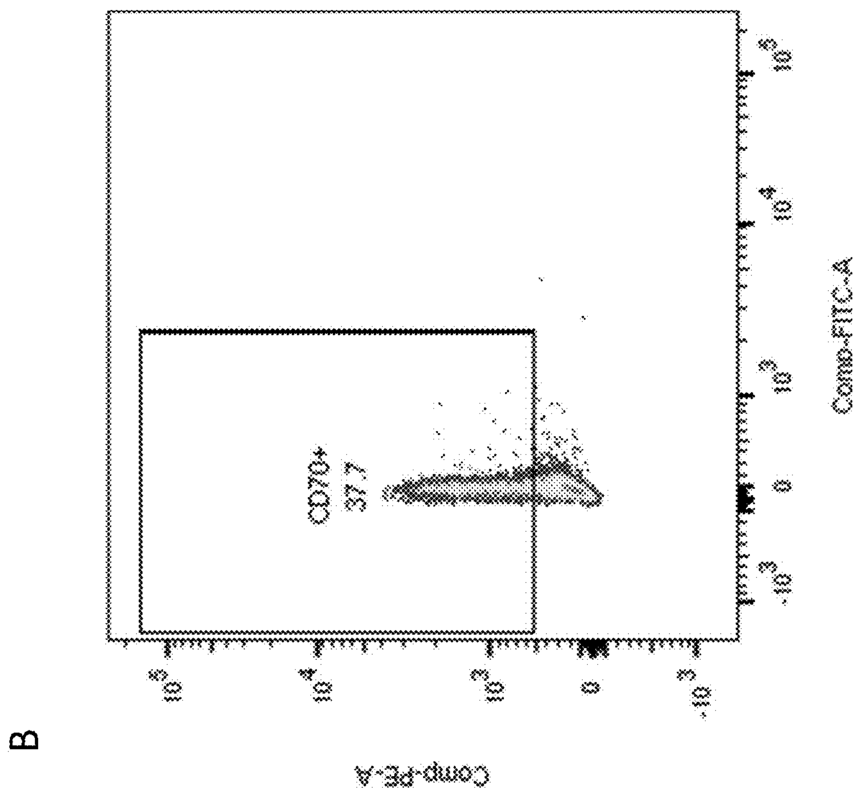
Figure 43C:
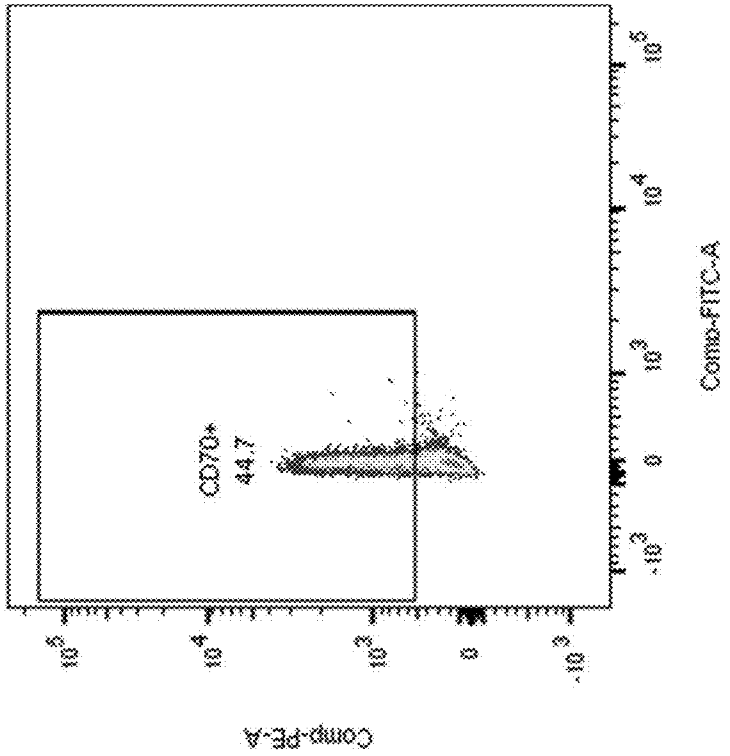
Figure 43D:
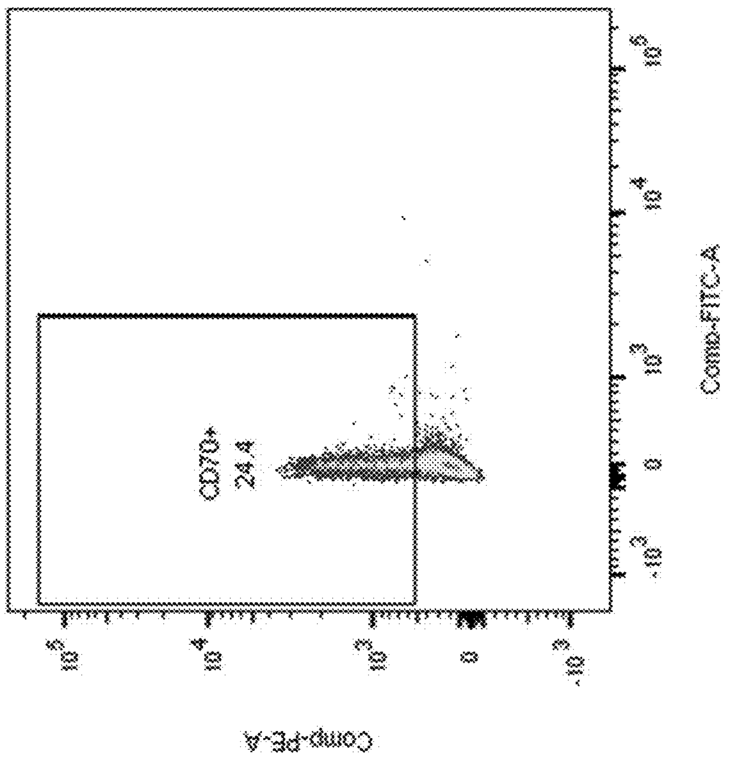
Figure 43E:
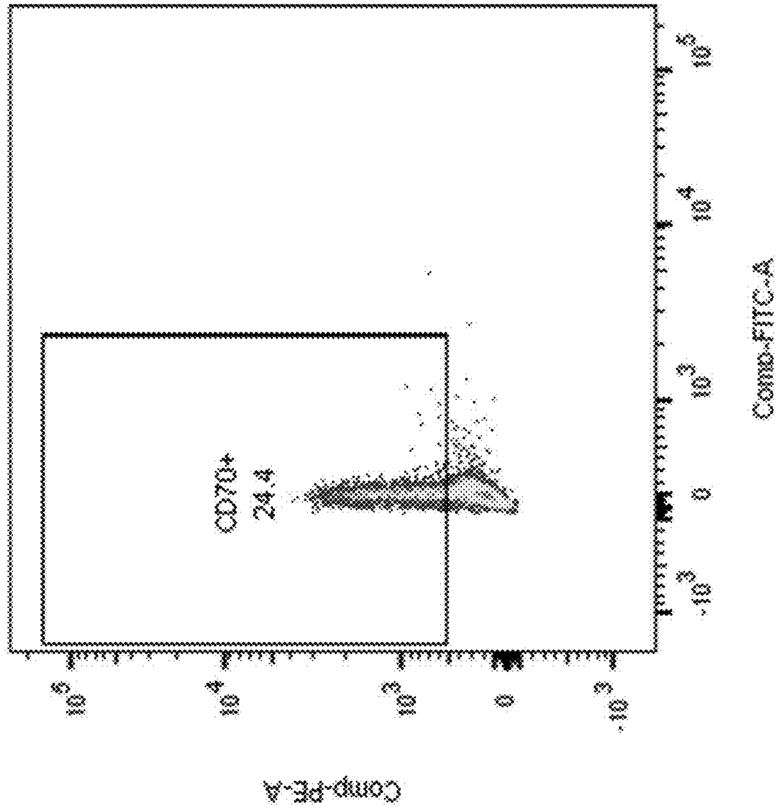
Figure 43F:
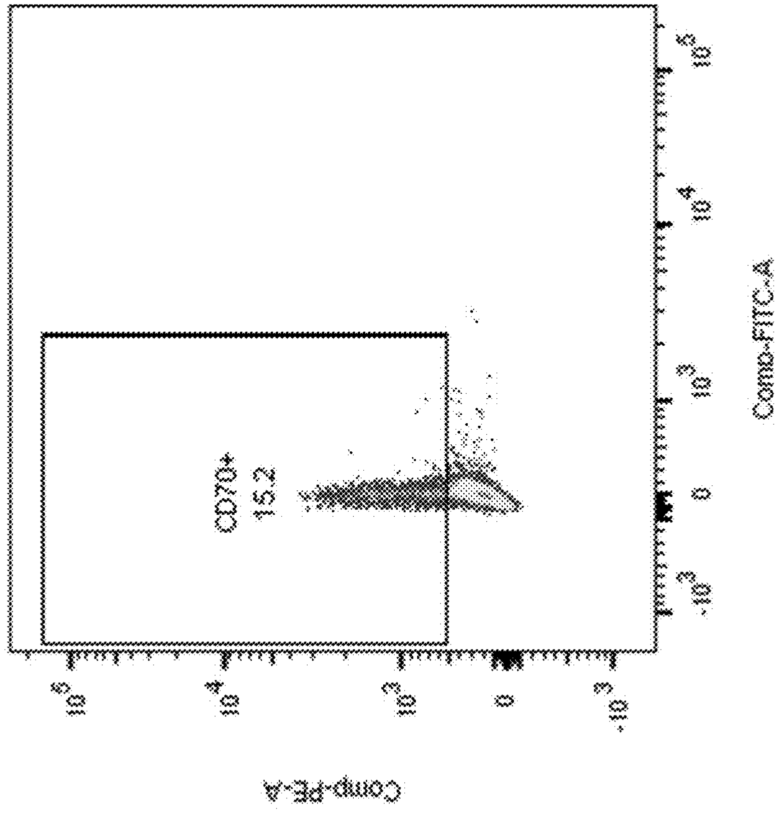
Figure 43G:
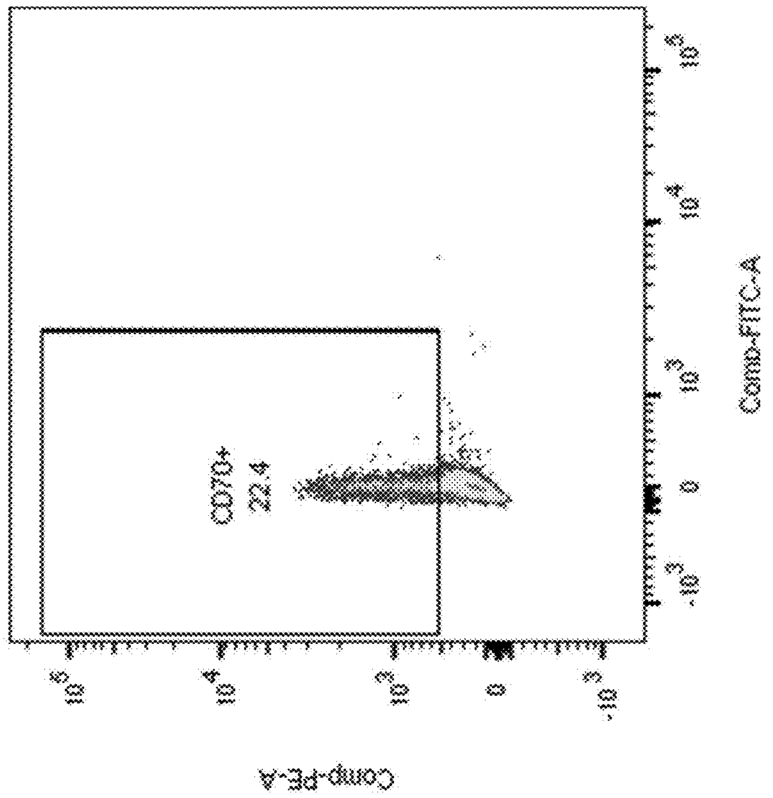
Figure 43H:
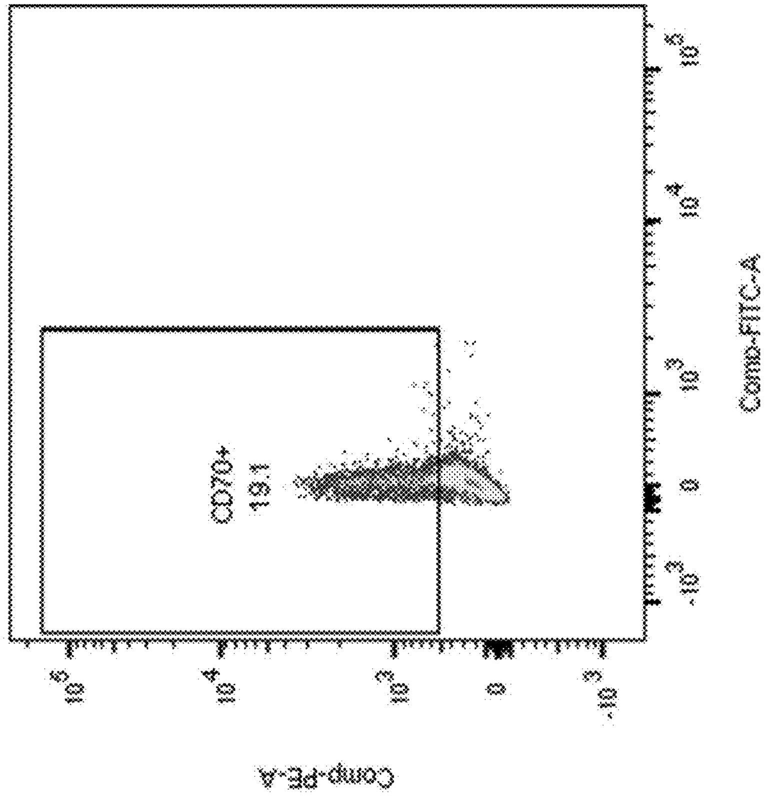
Figure 43I:
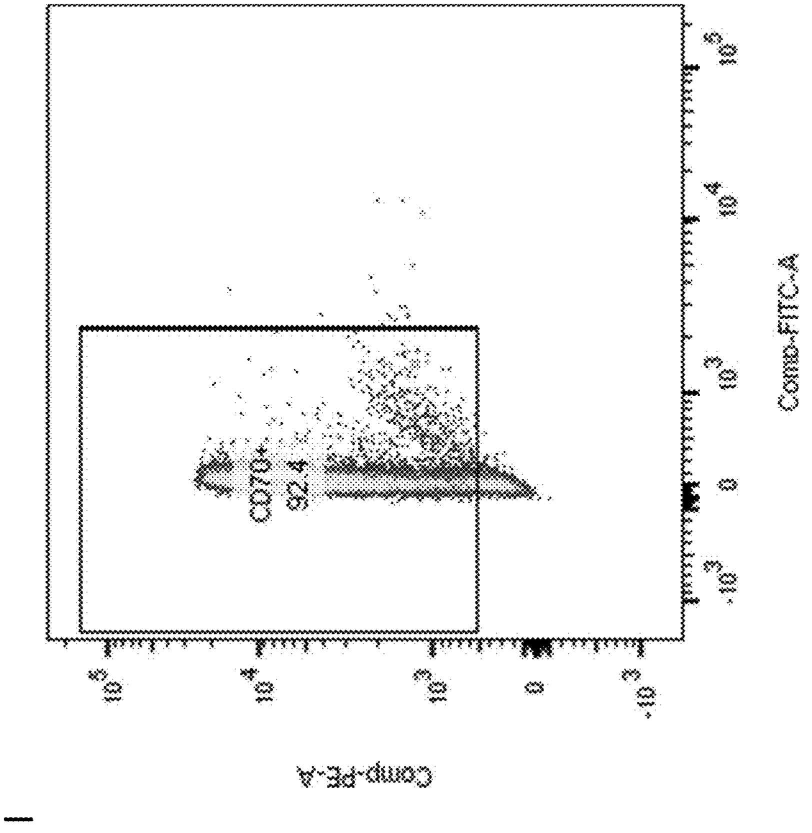

FIGS. 43A-43I relate to CD70 expression on NK cells (7 days post-electroporation) using various guide RNAs. FIG. 43A shows CD70 expression levels by NK cells subjected to gene editing to knockout expression of CD70 using gRNA 1. FIG. 43B shows CD70 expression levels by NK cells subjected to gene editing to knockout expression of CD70 using gRNA 2. FIG. 43C shows CD70 expression levels by NK cells subjected to gene editing to knockout expression of CD70 using gRNA 3. FIG. 43D shows CD70 expression levels by NK cells subjected to gene editing to knockout expression of CD70 using gRNAs 1 and 3. FIG. 43E shows CD70 expression levels by NK cells subjected to gene editing to knockout expression of CD70 using gRNAs 1 and 2. FIG. 43F shows CD70 expression levels by NK cells subjected to gene editing to knockout expression of CD70 using gRNAs 2 and 3. FIG. 43G shows CD70 expression levels by NK cells subjected to gene editing to knockout expression of CD70 using gRNA 1 (for CD70) and guide RNA to knockout CISH. FIG. 43H shows CD70 expression levels by NK cells subjected to gene editing to knockout expression of CD70 using gRNA 1 (for CD70) and guide RNA to knockout the adenosine receptor (A2AR). FIG. 43I shows control data from NK cells subject to electroporation alone (no gene editing enzymes or guide RNA).

Figure 44A:
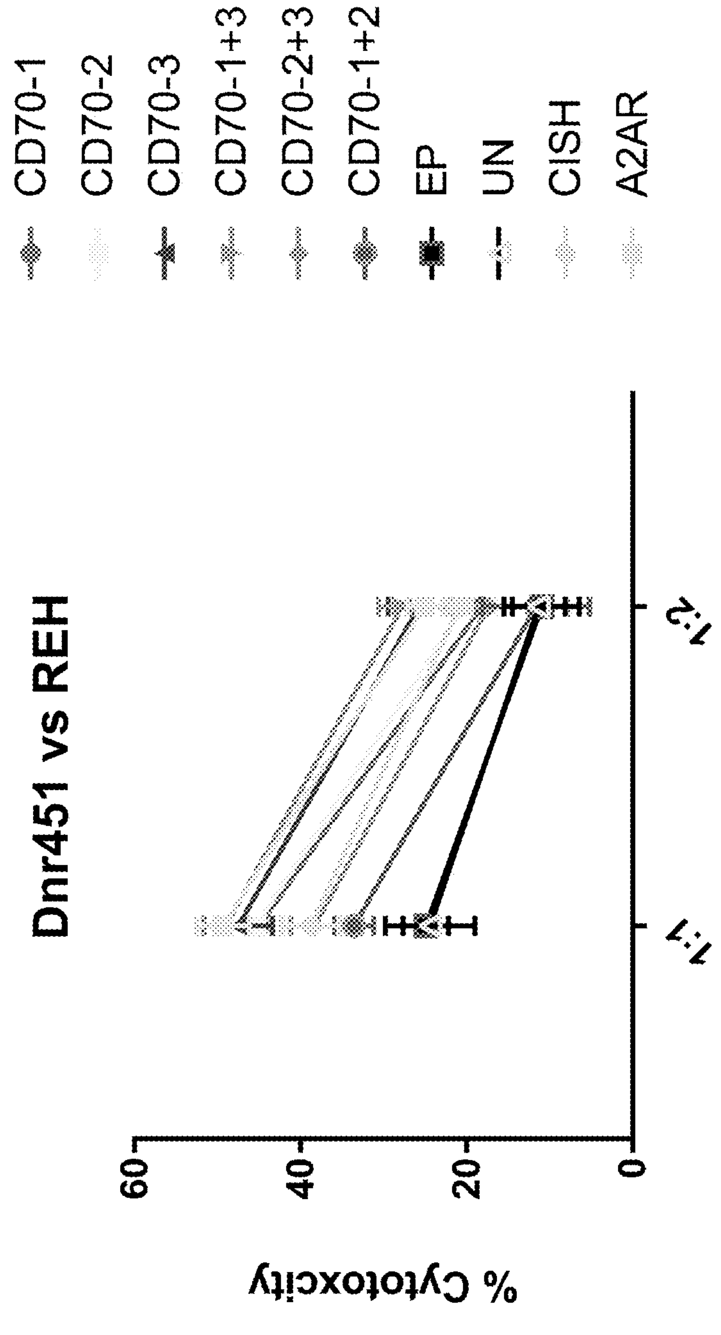
Figure 44C:
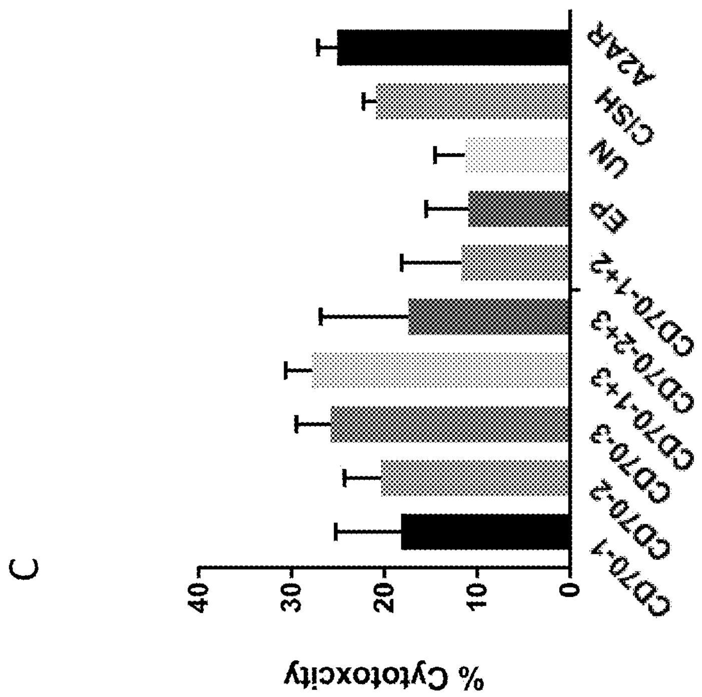
Figure 44B:
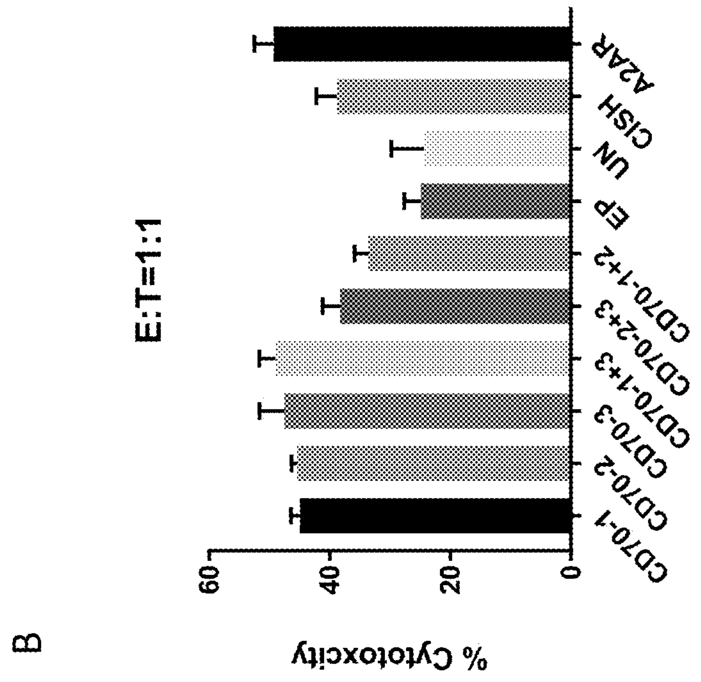
Figure 44D:
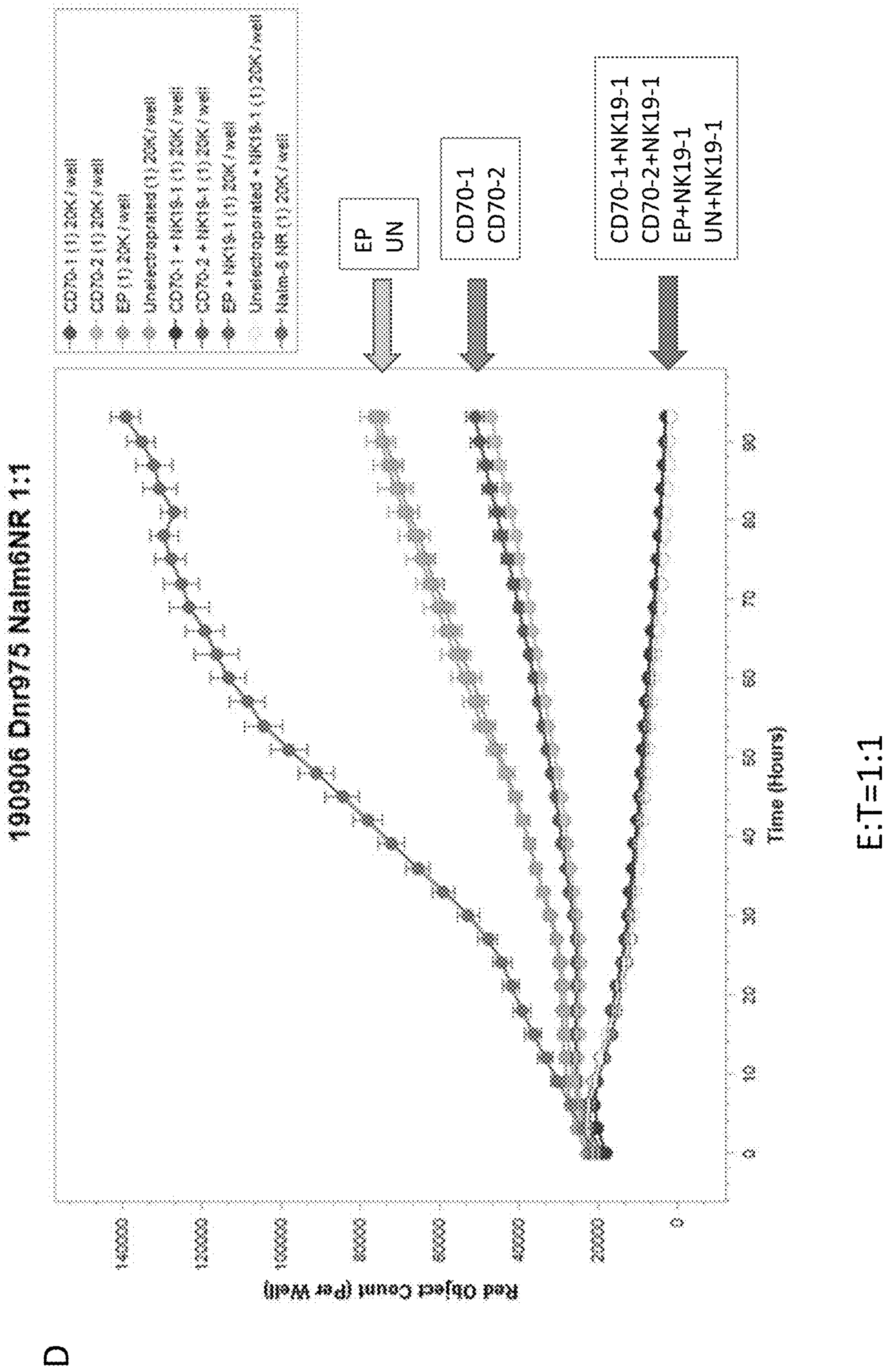

FIGS. 44A-44D relate to cytotoxicity evaluation of NK cells subjected to various gene editing protocols and engineered to express an anti-CD70 CAR (used here as a non-limiting embodiment is NK71, an anti-CD70 CAR). FIG. 44A shows cytotoxicity of the indicated NK cells against Reh tumor cells, at either a 1:1 or 1:2 effector:target ratio. FIG. 44B shows a summary histogram of the cytotoxicity at 1:1. FIG. 44C shows a summary histogram of the cytotoxicity at 1:2. FIG. 44D shows cytotoxicity of the indicated constructs against Nalm-6 tumor cells.

Figure 45A:
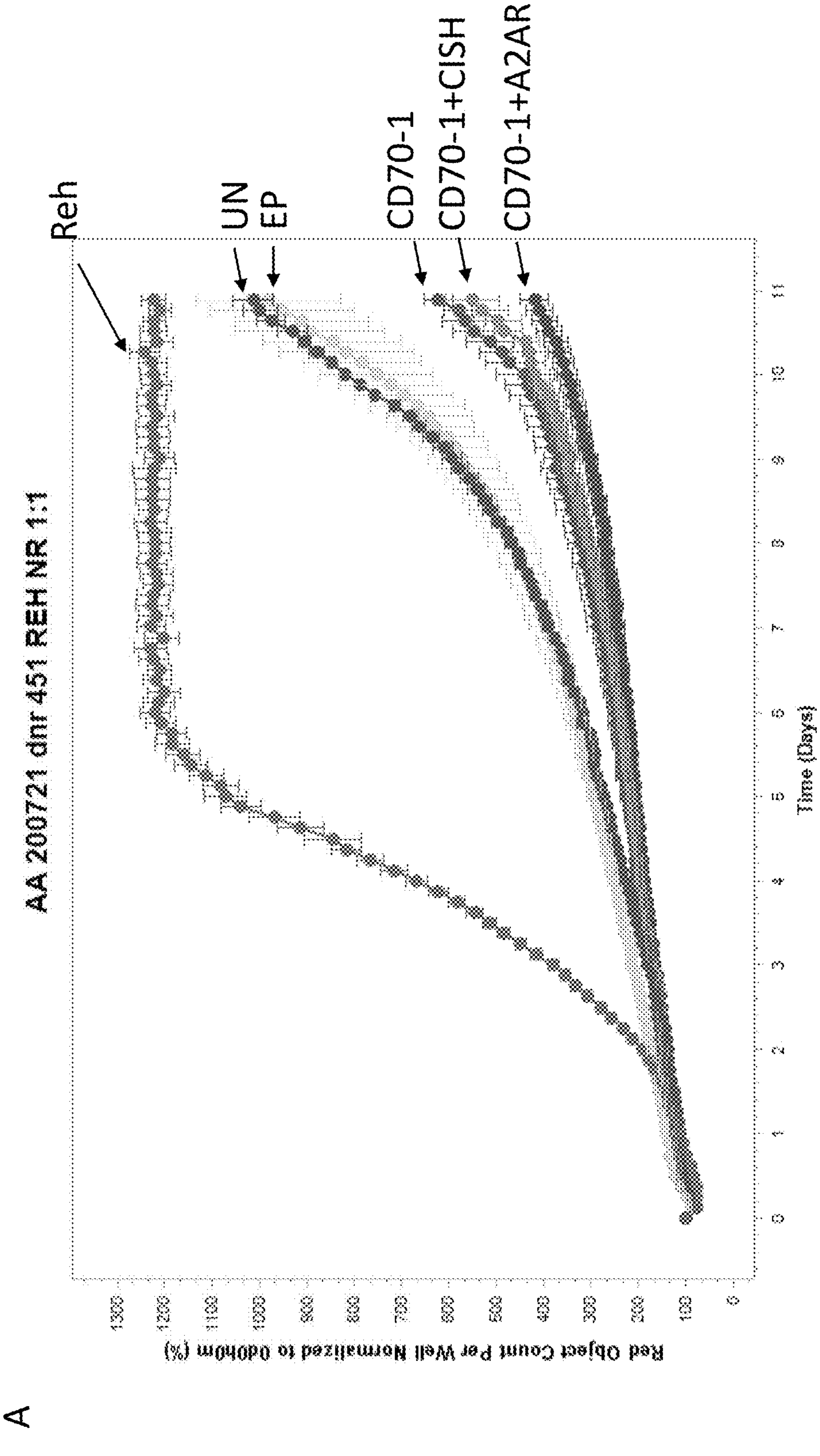
Figure 45B:
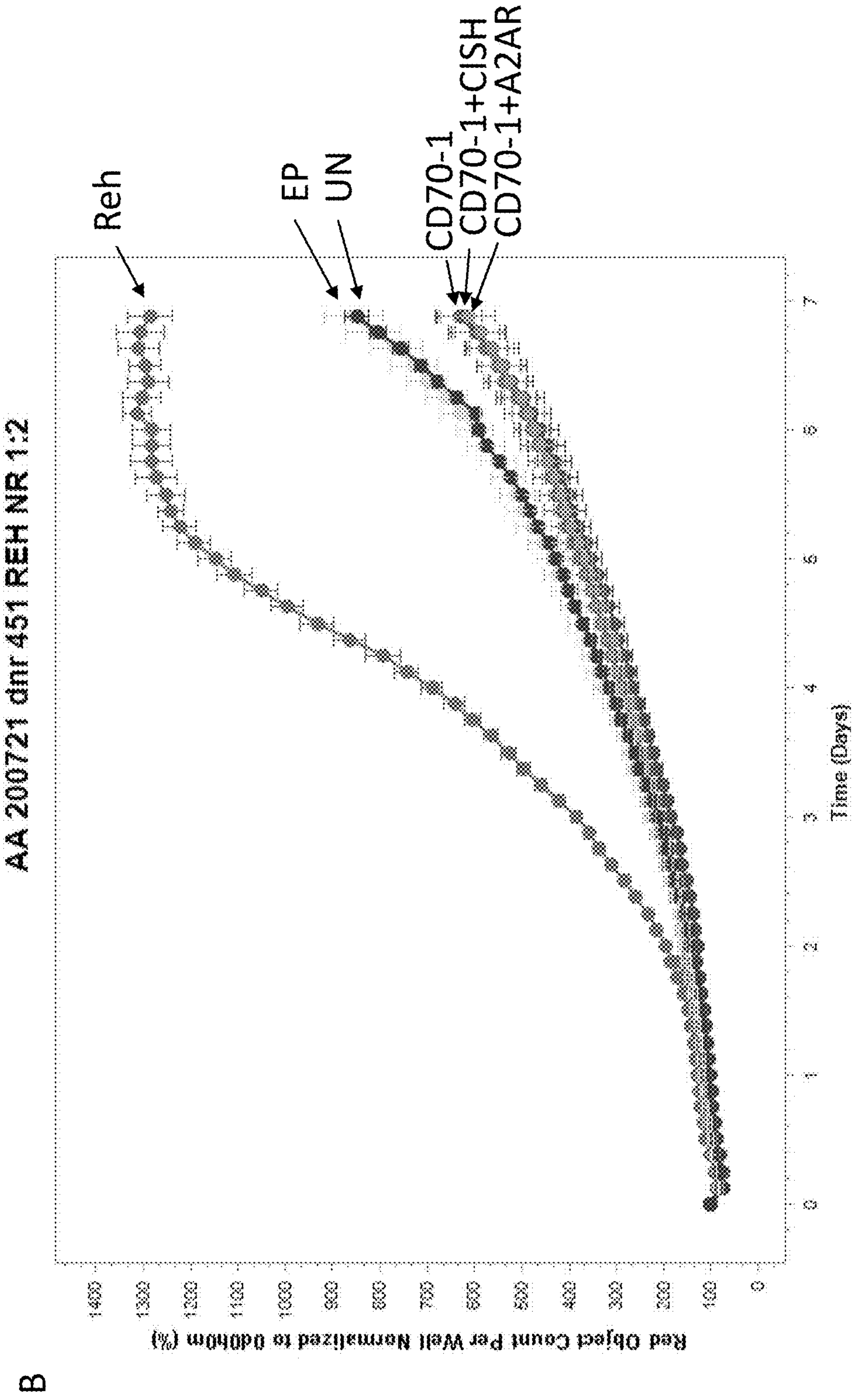

FIGS. 45A-45B show cytotoxicity evaluation of NK cells subjected to various gene editing protocols and engineered to express an anti-CD70 CAR (used here as a non-limiting embodiment is NK71, an anti-CD70 CAR). FIG. 45A shows cytotoxicity of the indicated NK cells against Reh tumor cells at a 1:1 E:T ratio. FIG. 45B shows cytotoxicity of the indicated NK cells against Reh tumor cells at a 1:2 E:T ratio.

Figure 46B:
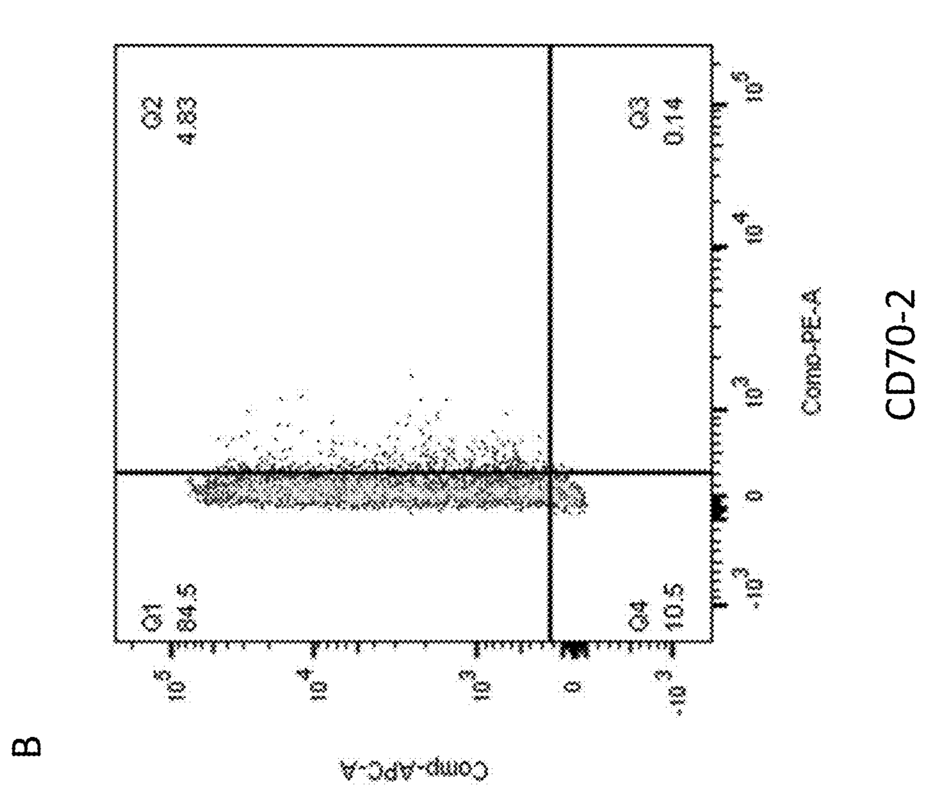
Figure 46A:
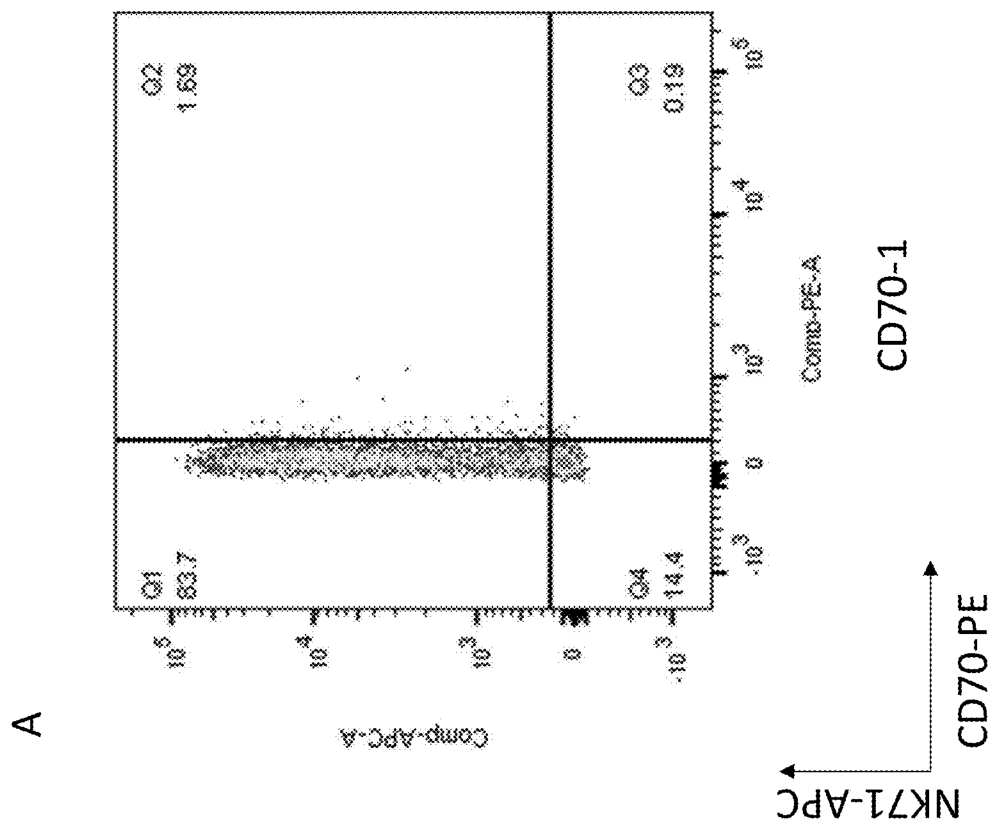
Figure 46D:
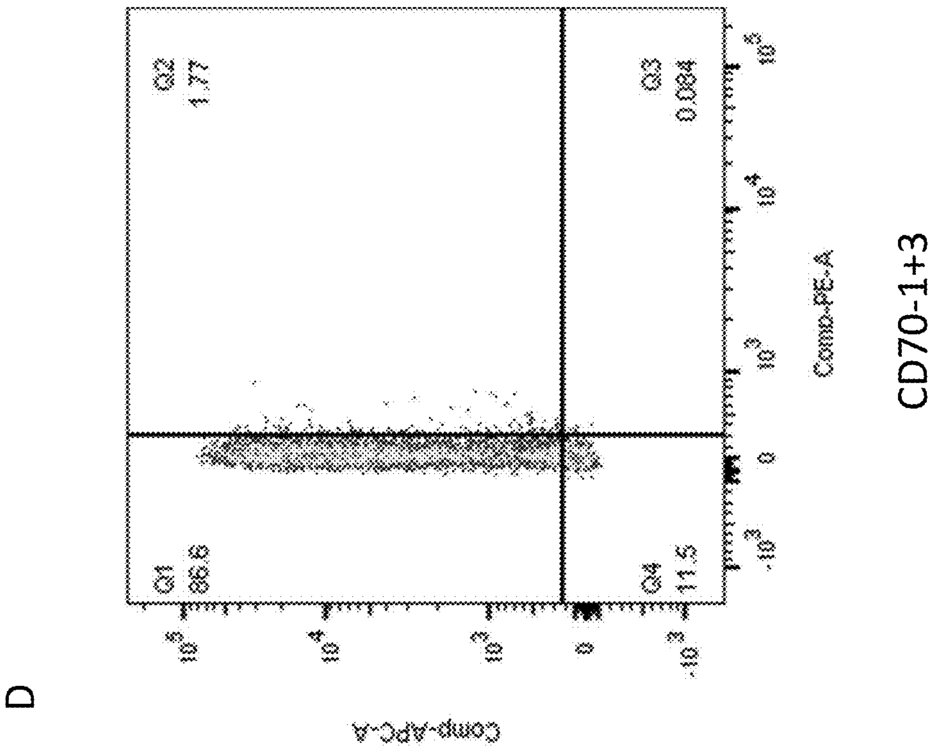
Figure 46C:
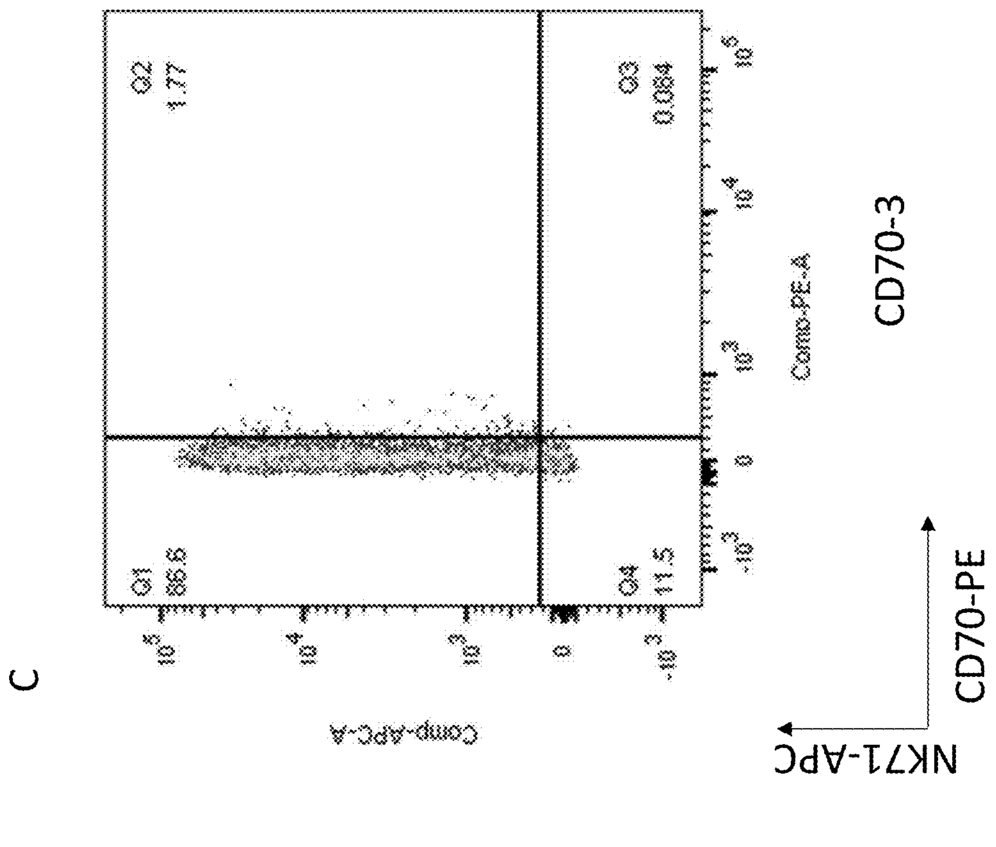
Figure 46E:
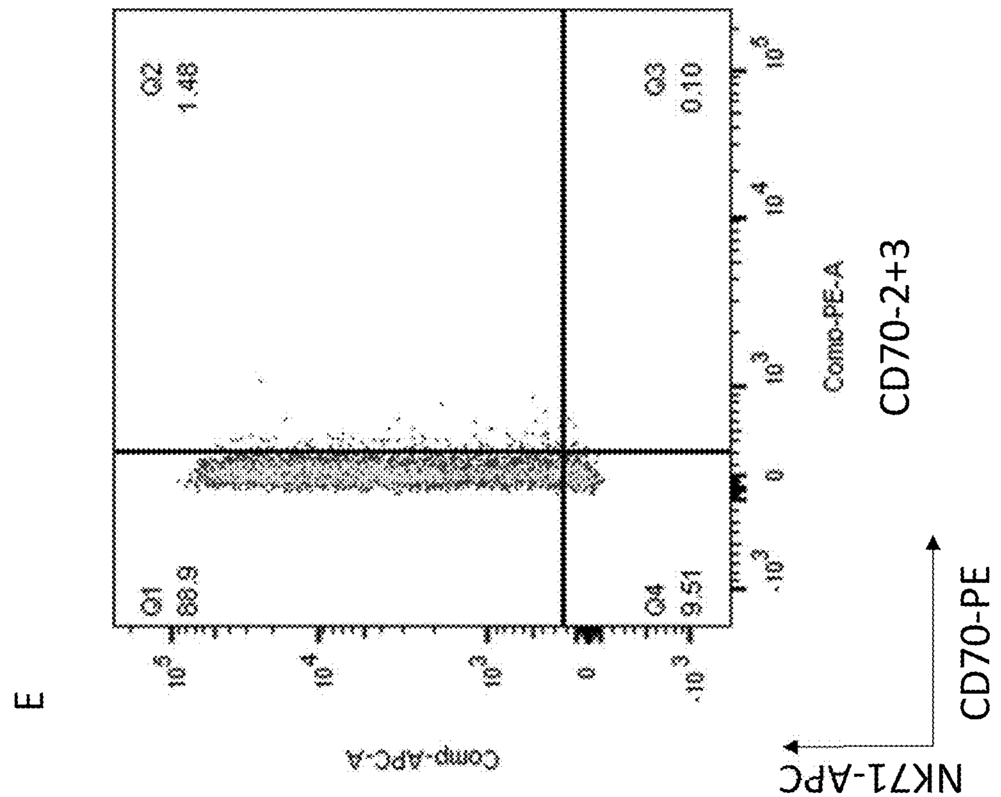
Figure 46F:
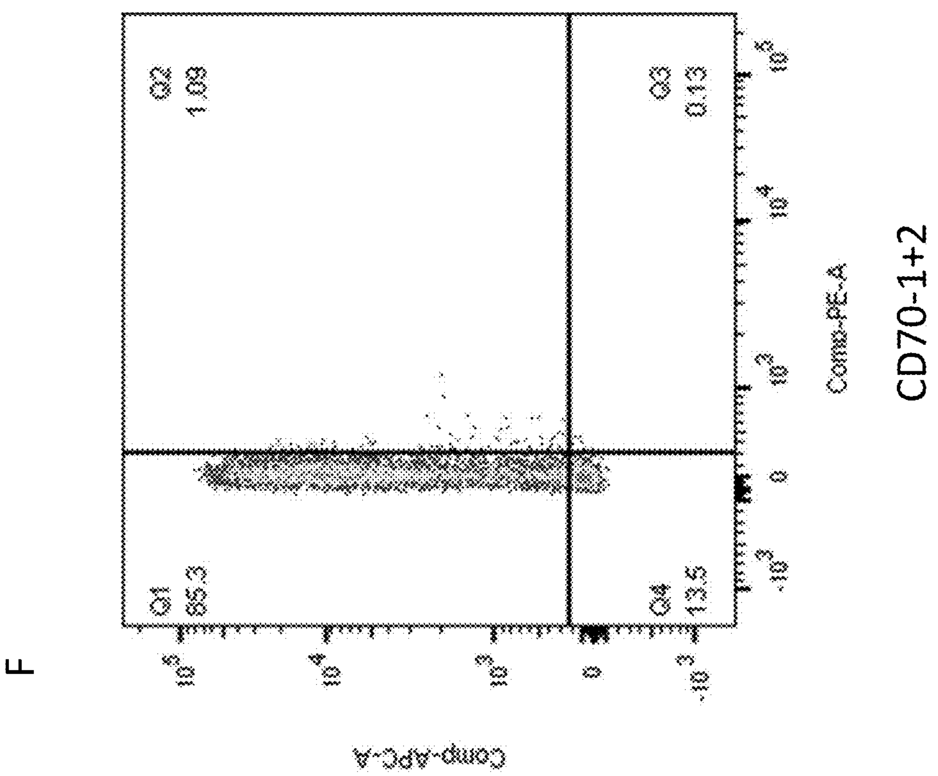
Figure 46H:
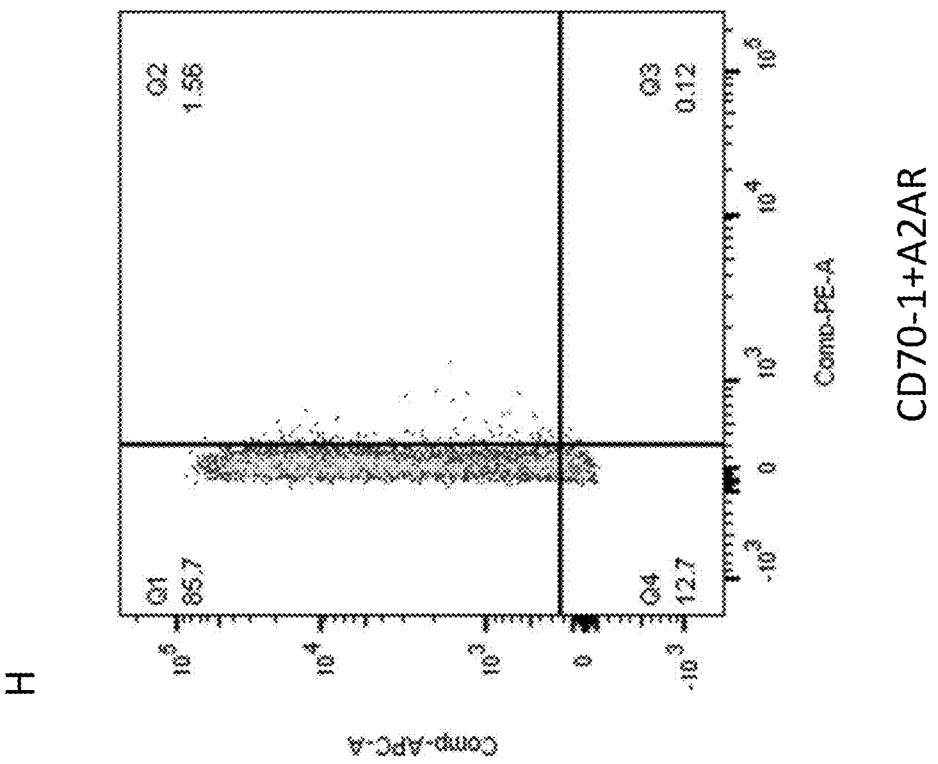
Figure 46G:
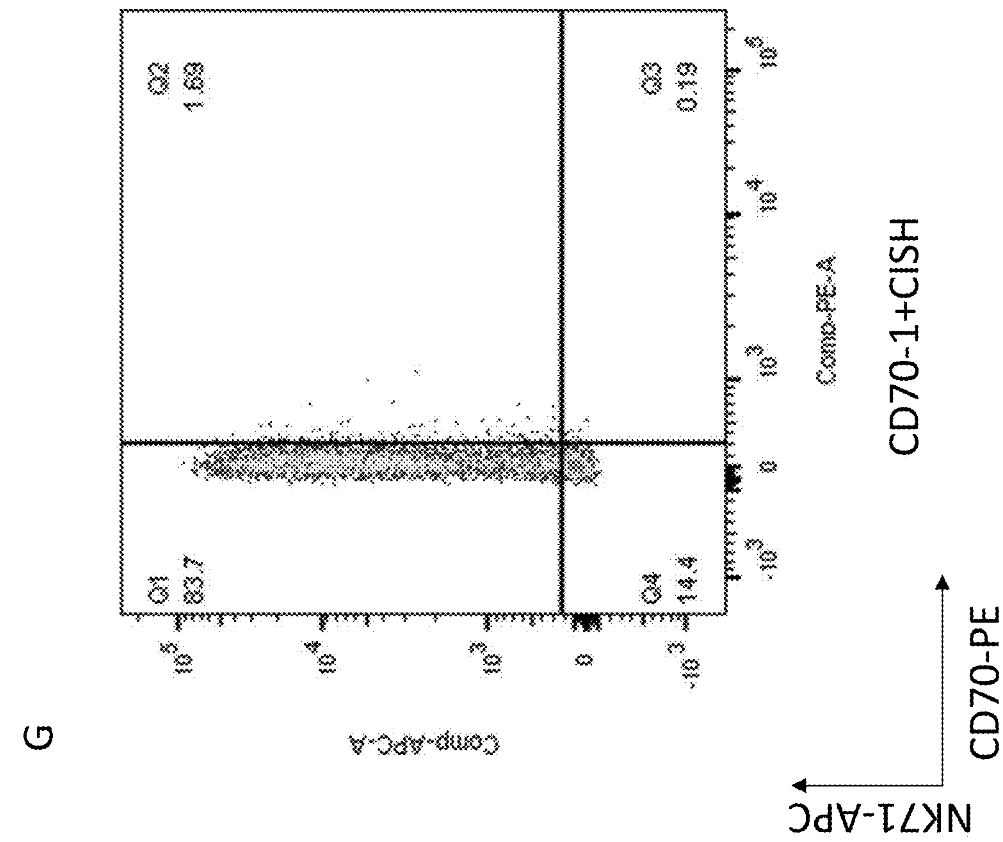
Figure 46J:
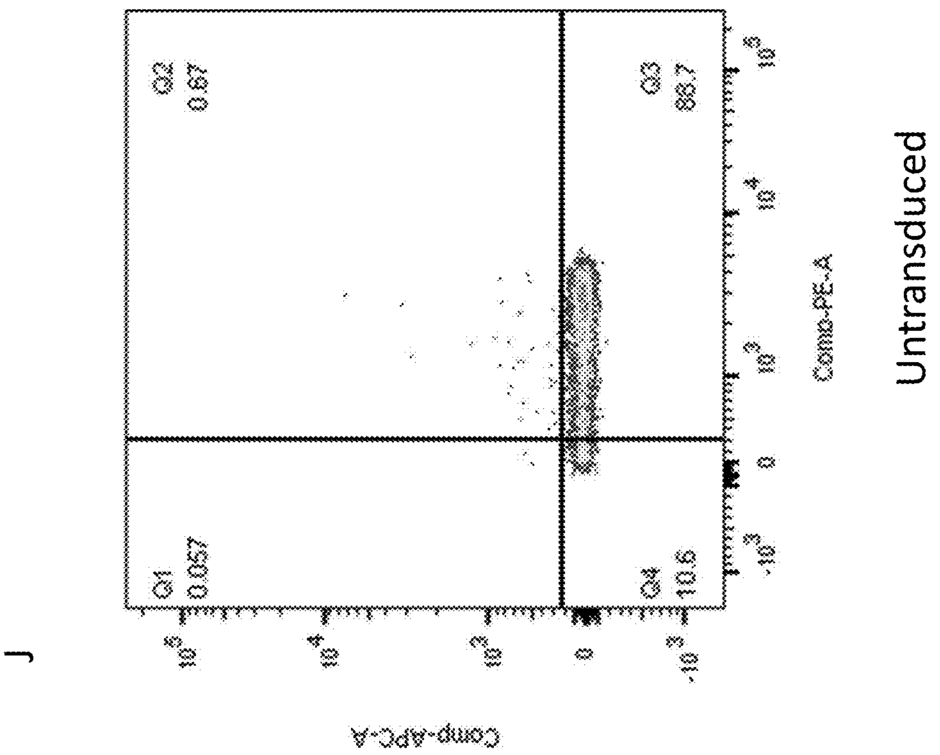
Figure 46I:
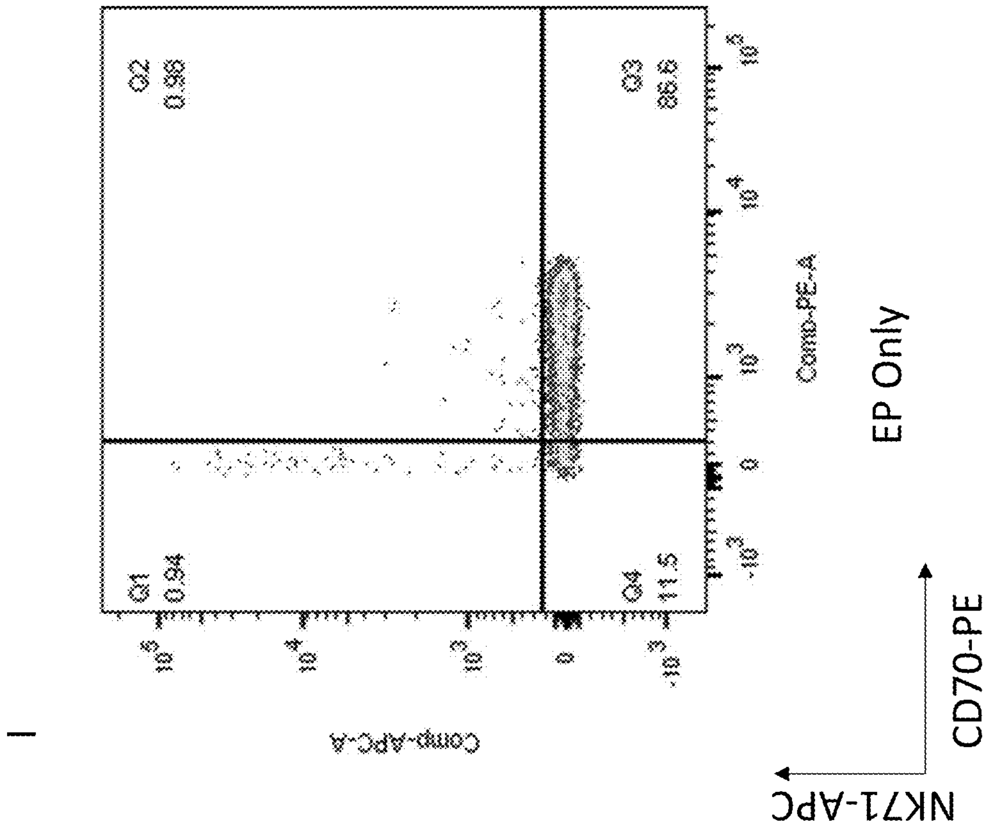

FIGS. 46A-46J show data related to the expression of an anti-CD70 CAR in NK cells subjected to gene editing to knockout native CD70 expression (and/or CISH or adenosine receptor expression) as well as expression of native CD70 by the NK cells. FIG. 46A shows data for antiCD70 CAR expression and native CD70 expression levels by NK cells subjected to gene editing using gRNA 1 (for CD70). FIG. 46B shows data for antiCD70 CAR expression and native CD70 expression levels by NK cells subjected to gene editing using gRNA 2 (for CD70). FIG. 46C shows data for antiCD70 CAR expression and native CD70 expression levels by NK cells subjected to gene editing using gRNA 3 (for CD70). FIG. 46D shows data for antiCD70 CAR expression and native CD70 expression levels by NK cells subjected to gene editing using gRNAs 1 and 3 (both for CD70). FIG. 46E shows data for antiCD70 CAR expression and native CD70 expression levels by NK cells subjected to gene editing using gRNAs 2 and 3 (both for CD70). FIG. 46F shows data for antiCD70 CAR expression and native CD70 expression levels by NK cells subjected to gene editing using gRNAs 1 and 2 (both for CD70). FIG. 46G shows data for antiCD70 CAR expression and native CD70 expression levels by NK cells subjected to gene editing using gRNA 1 (for CD70) and additional gRNA to knockout CISH. FIG. 46H shows data for antiCD70 CAR expression and native CD70 expression levels by NK cells subjected to gene editing using gRNA 1 (for CD70) and additional gRNA to knockout expression of the adenosine receptor (A2AR). FIG. 46I shows control data where NK cells were subjected to electroporation only, but no gRNA or engineered CAR expression. FIG. 46J shows control data with un-transduced NK cells.

Figure 47A:
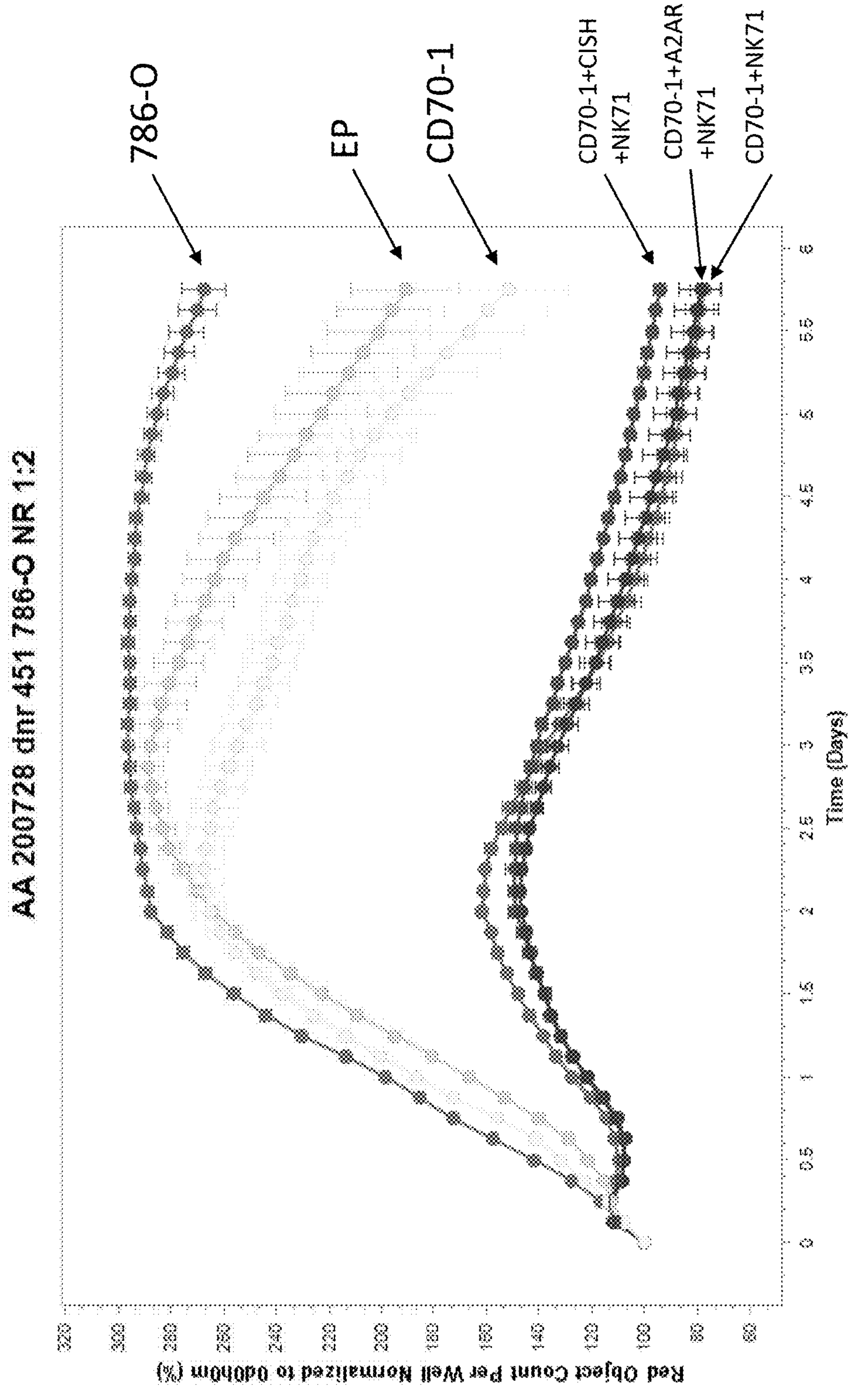
Figure 47B:
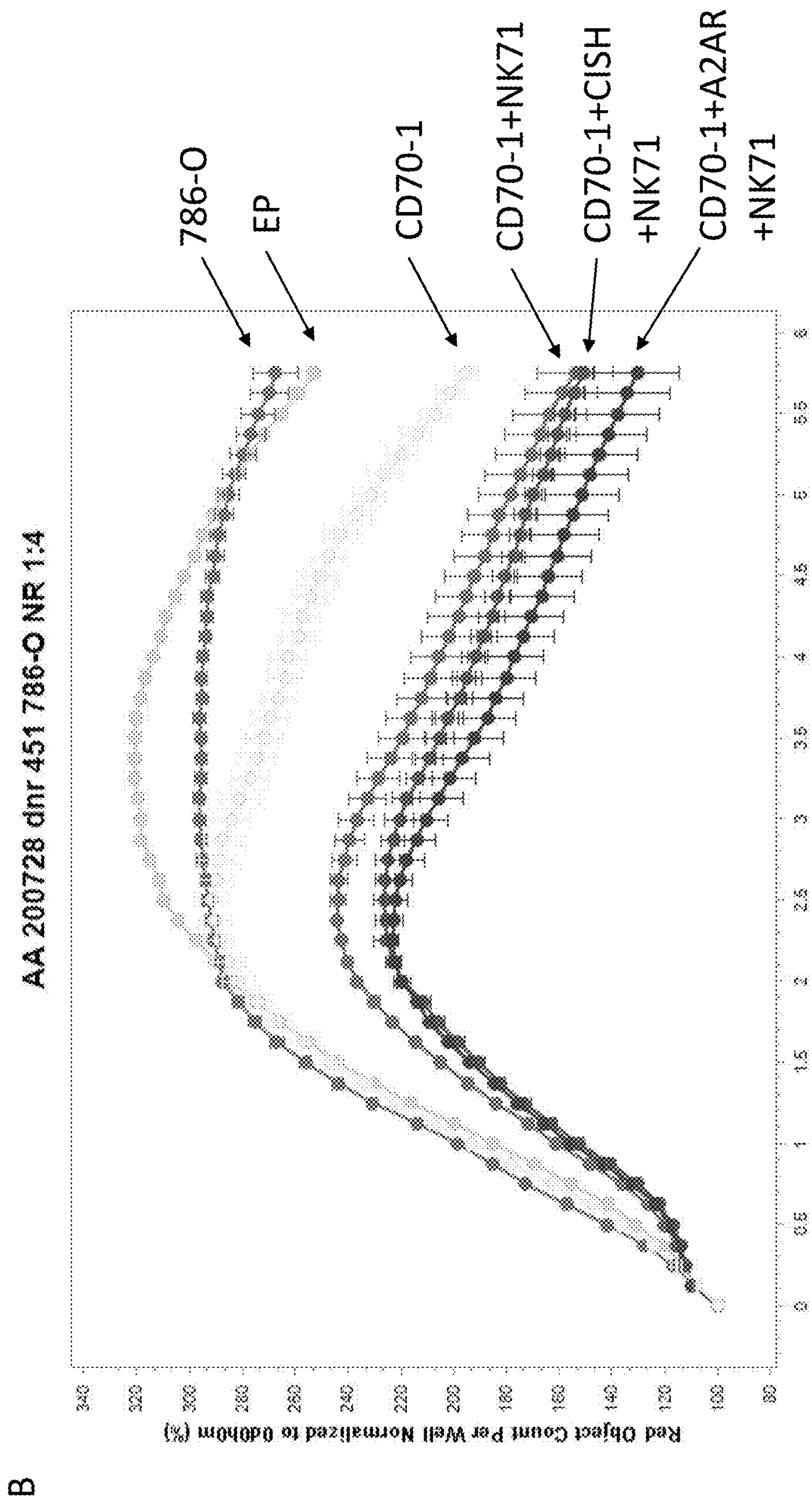
Figure 47C:
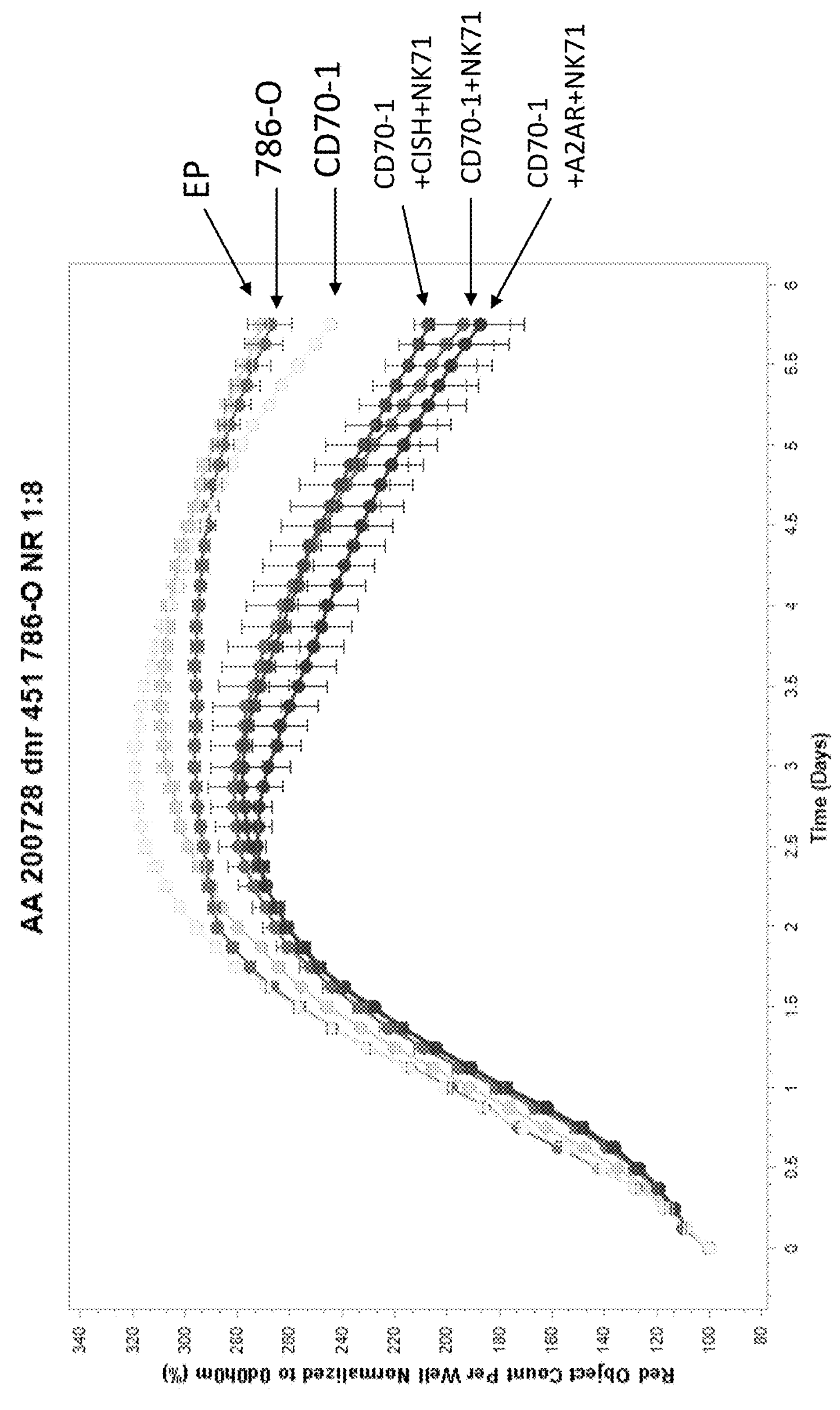
Figure 47D:
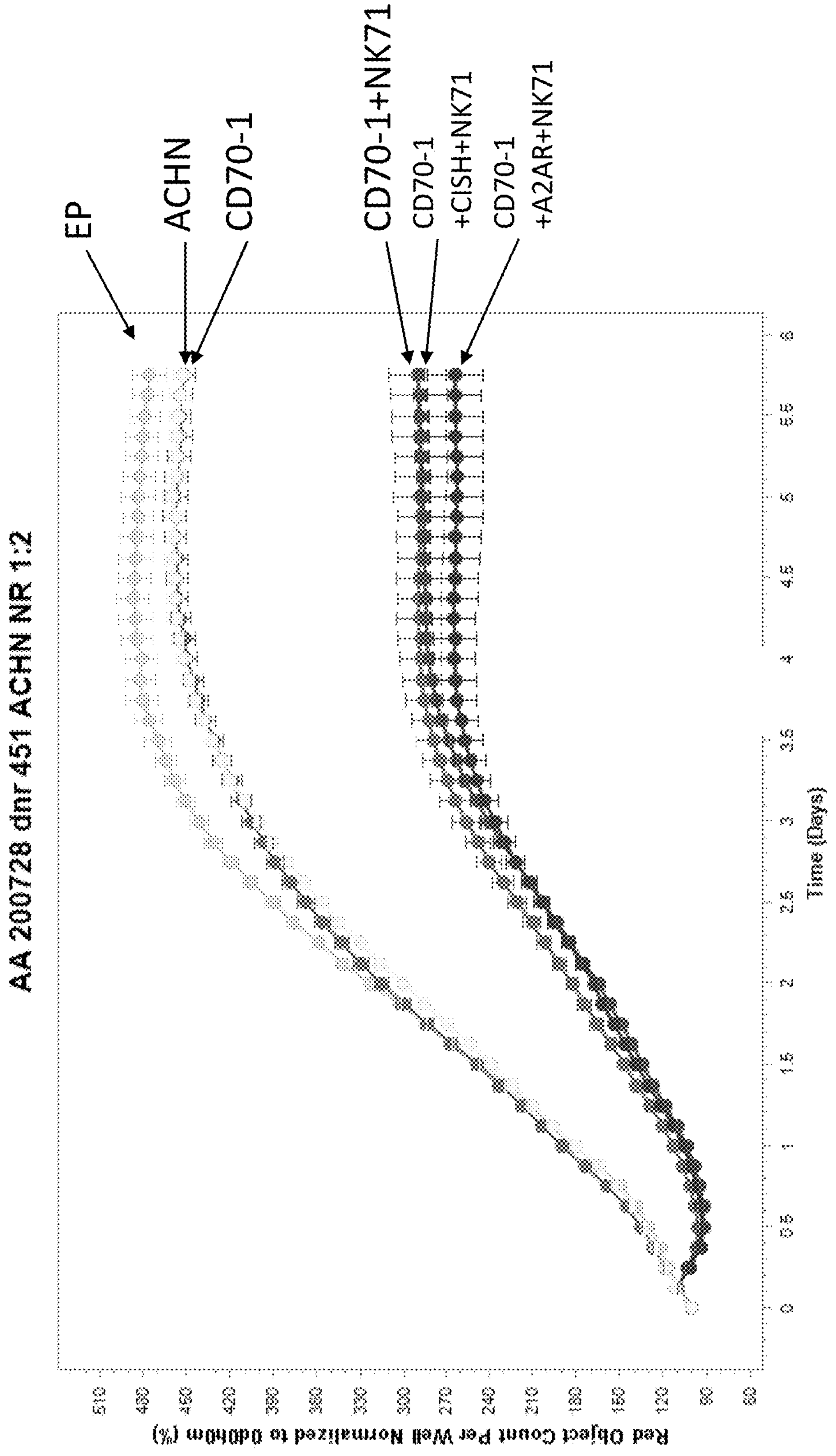
Figure 47E:
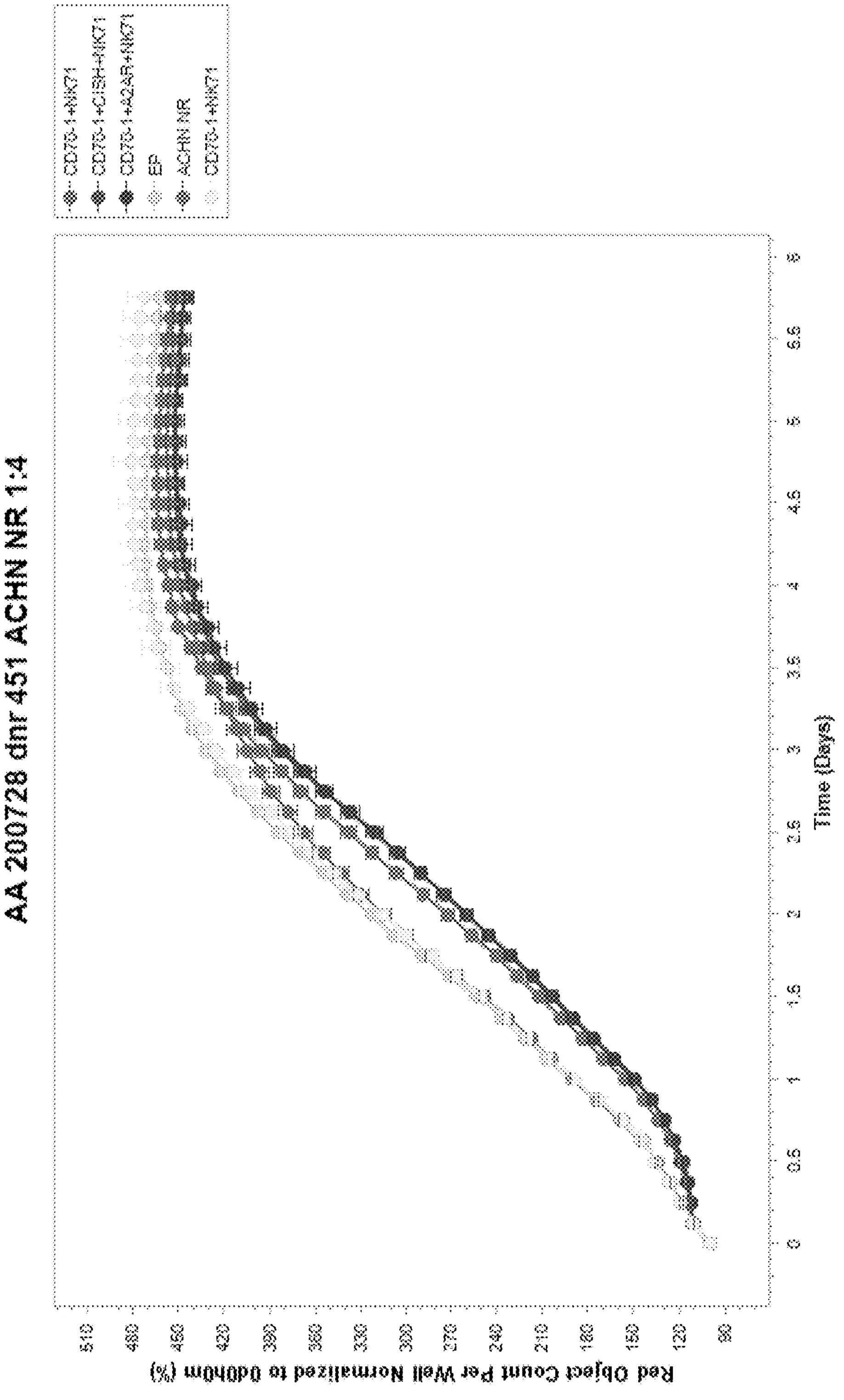
Figure 47F:
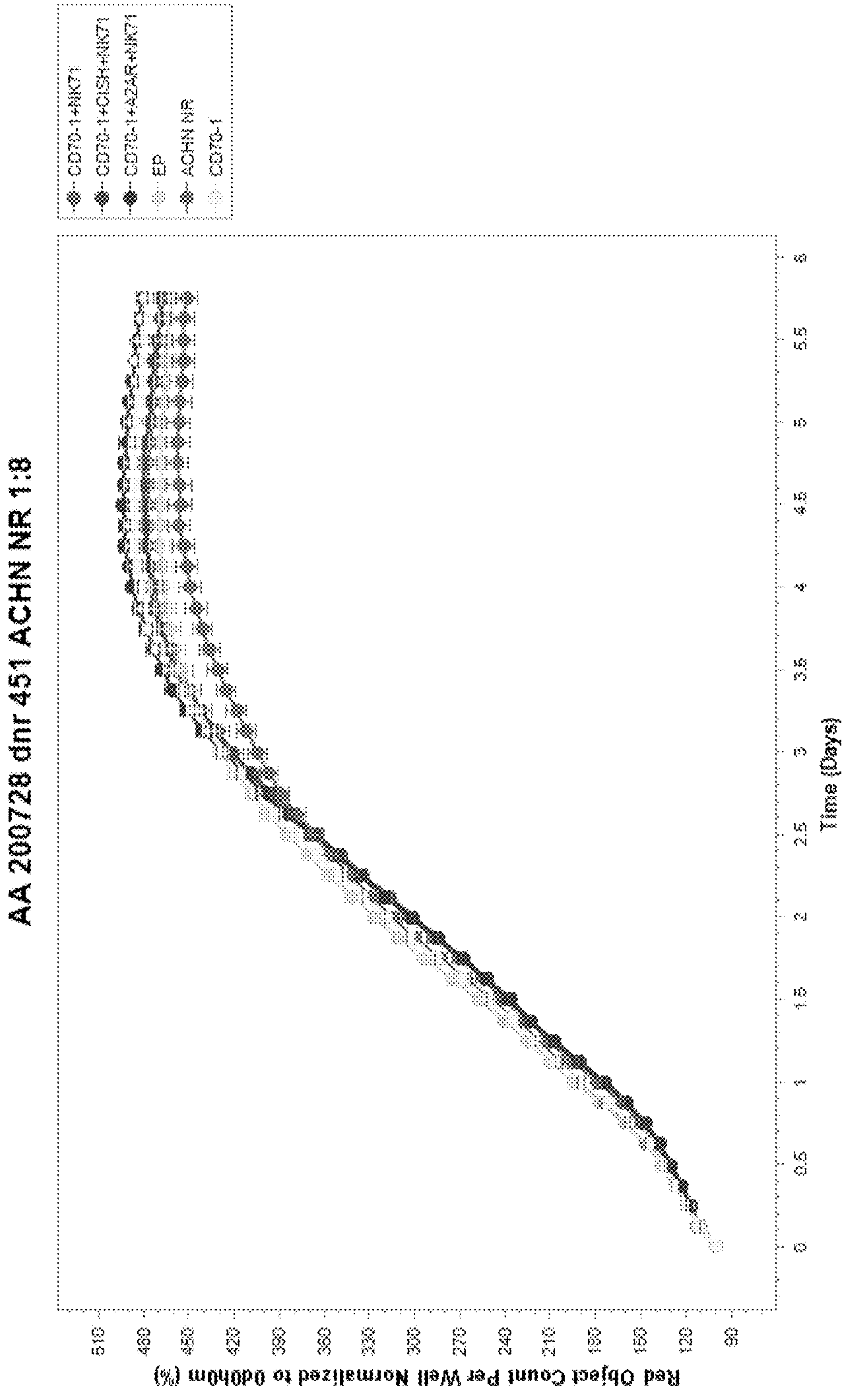

FIGS. 47A-47F show cytotoxicity data related to anti-CD70 CAR-expressing, and gene edited, NK cells against tumor cells. FIG. 47A shows cytotoxicity data of the indicated NK cells against 786-O cells at a 1:2 E:T ratio. FIG. 47B shows cytotoxicity data of the indicated NK cells against 786-O cells at a 1:4 E:T ratio. FIG. 47C shows cytotoxicity data of the indicated NK cells against 786-O cells at a 1:8 E:T ratio. FIG. 47D shows cytotoxicity data of the indicated NK cells against ACHN cells at a 1:2 E:T ratio. FIG. 47E shows cytotoxicity data of the indicated NK cells against ACHN cells at a 1:4 E:T ratio. FIG. 47F shows cytotoxicity data of the indicated NK cells against ACHN cells at a 1:8 E:T ratio.

Figure 48A:
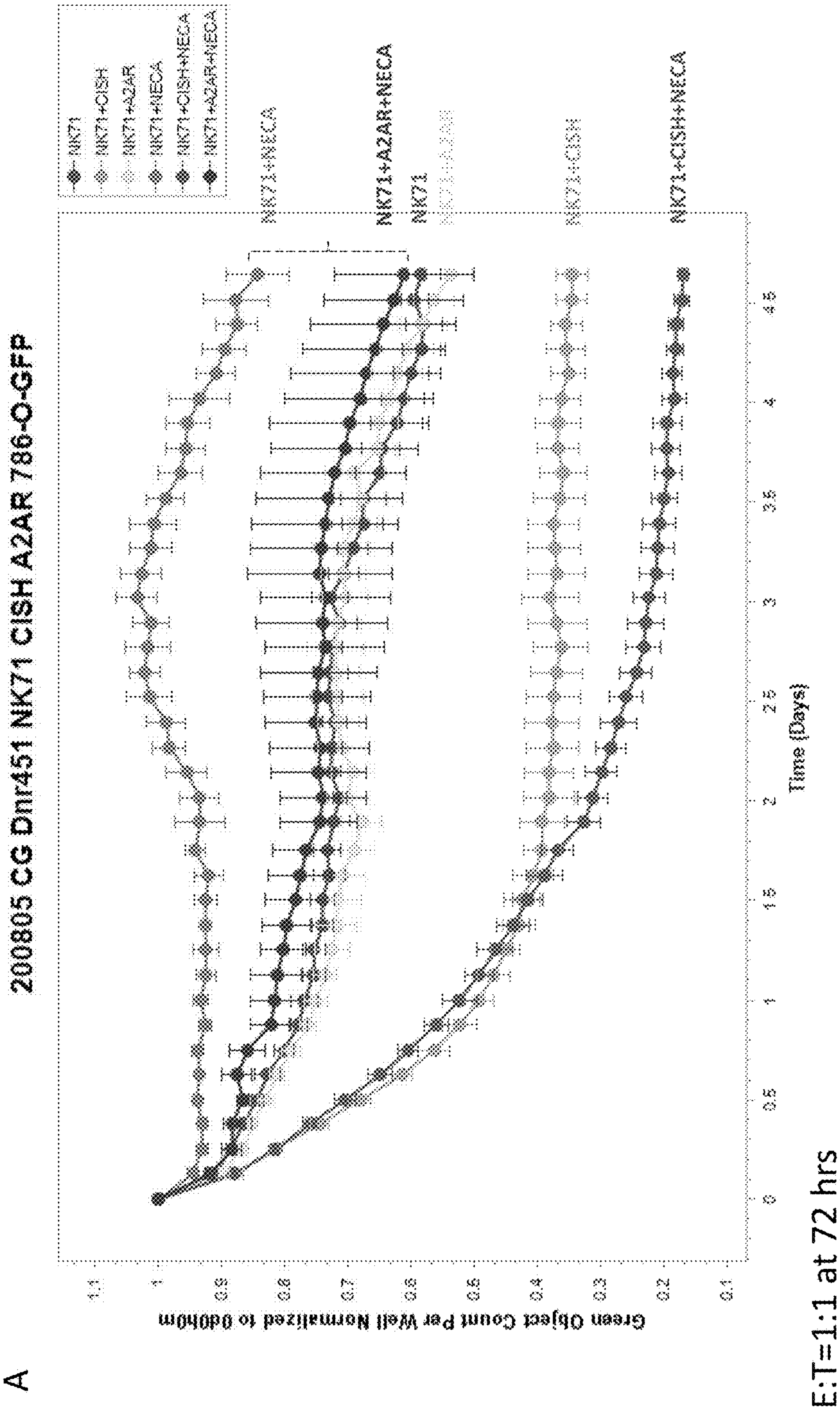
Figure 48B:
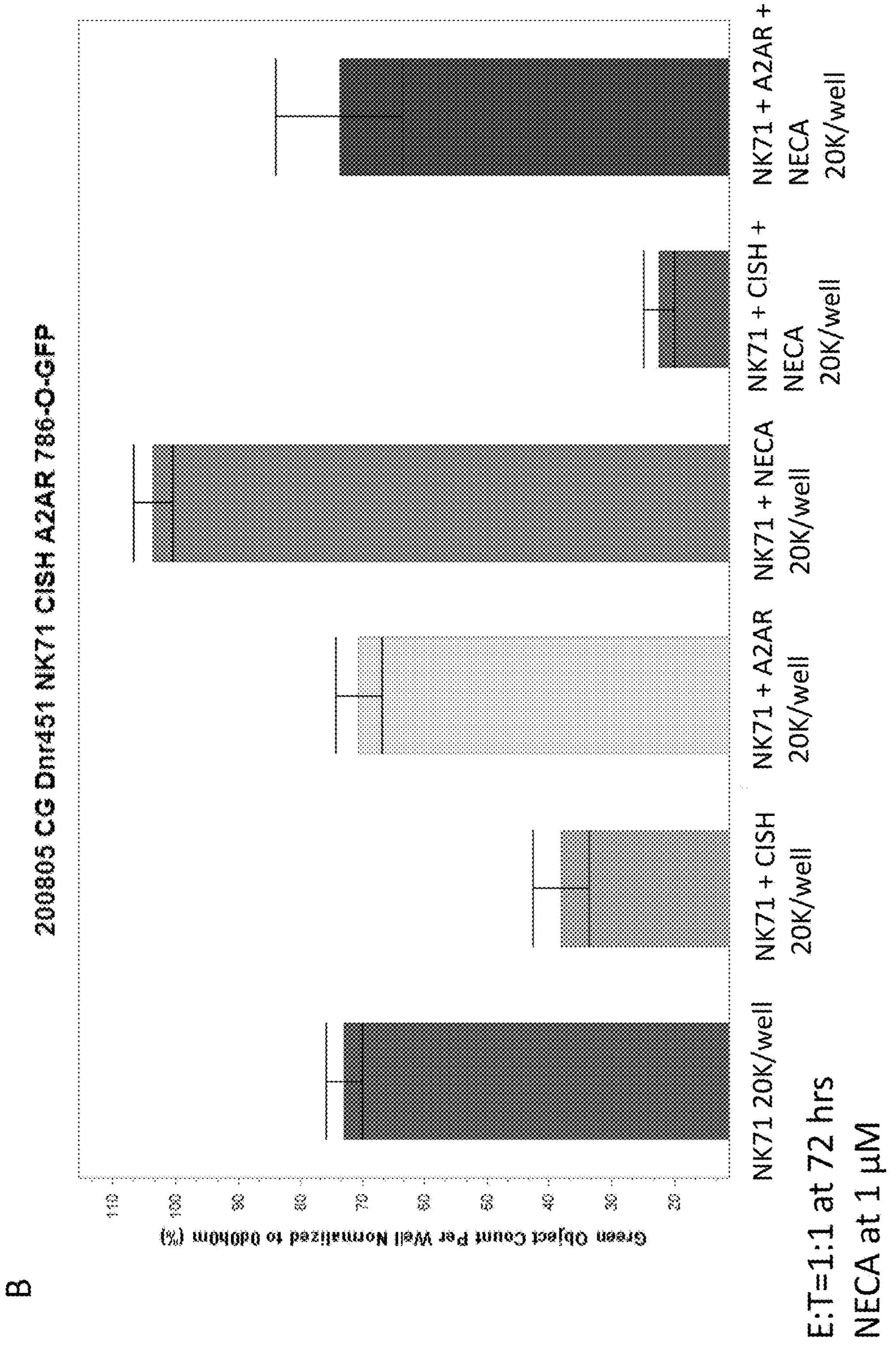
Figure 48C:
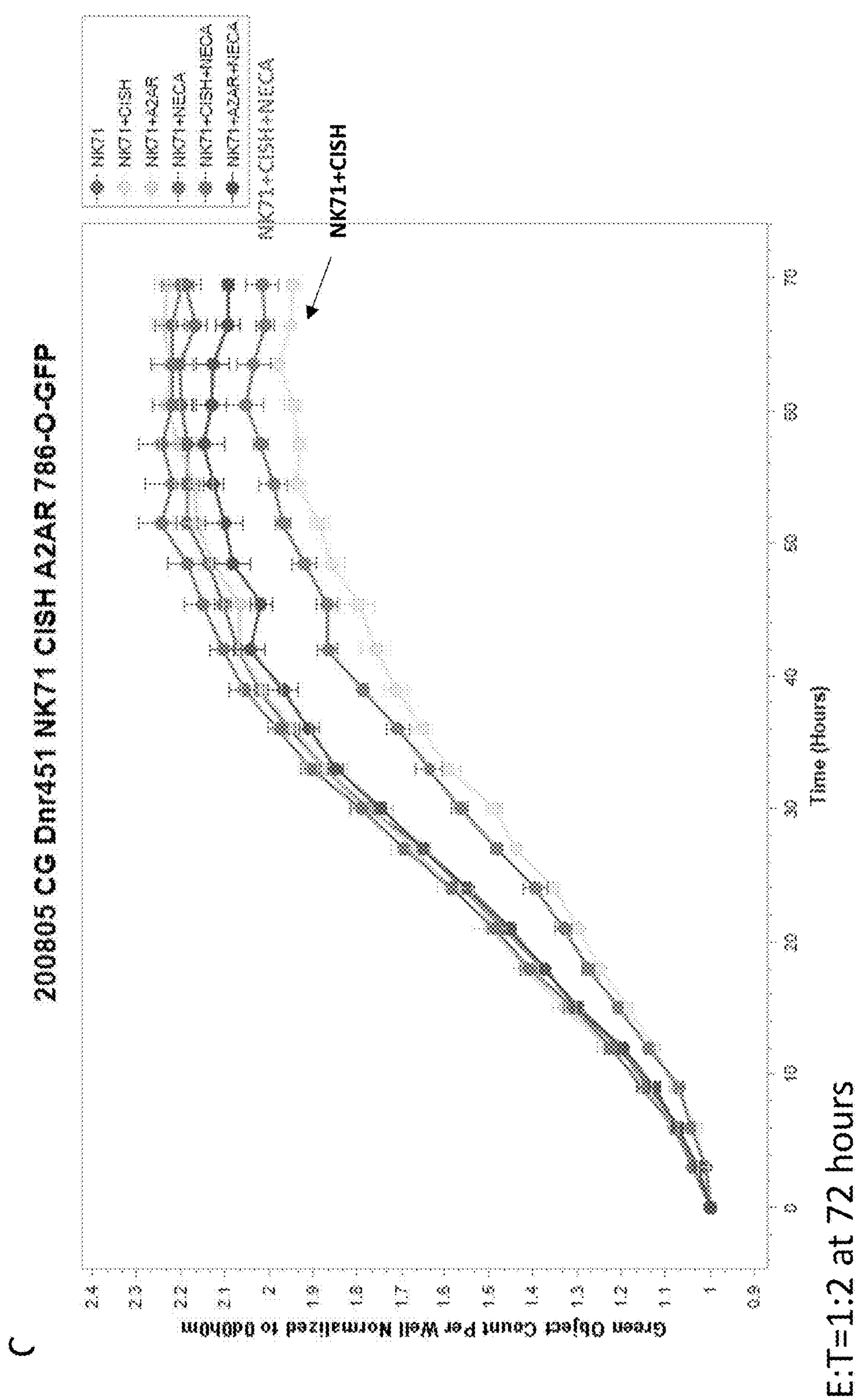
Figure 48D:
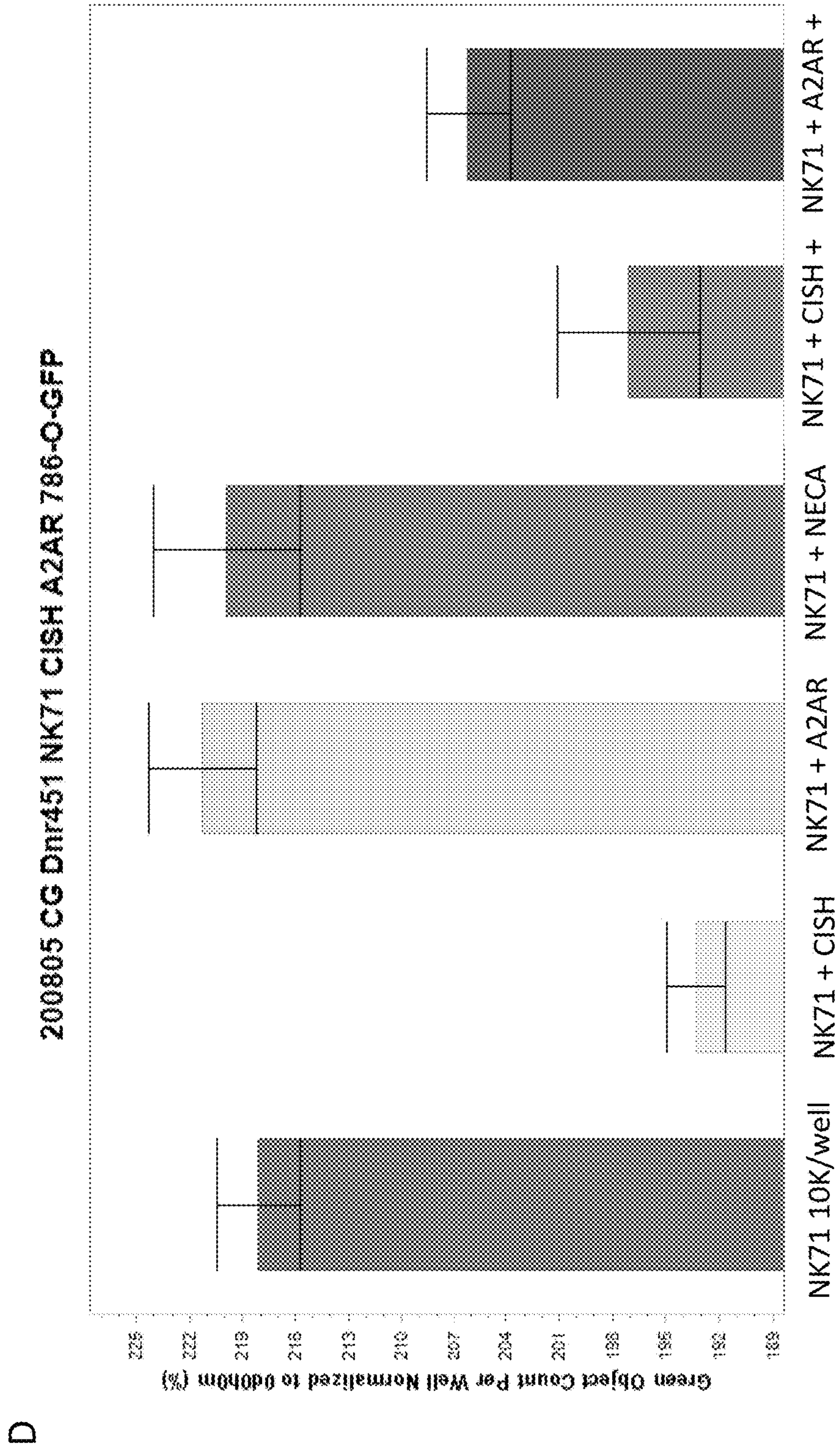

FIGS. 48A-48D show cytotoxicity data from various gene edited NK cells that also are engineered to express an anti-CD70 CAR against tumor cells. FIG. 48A shows cytotoxicity data from the indicated gene edited NK cells expressing an anti-CD70 CAR against 786-O cells at a 1:1 ratio, with data collected at 72 hours after co-culturing with the tumor cells. FIG. 48B shows summary data of GFP detection, a surrogate for live tumor cell number, measured as a percent of baseline GFP detection (as of time zero). FIG. 48C shows cytotoxicity data from the indicated gene edited NK cells expressing an anti-CD70 CAR against 786-O cells at a 1:2 ratio, with data collected at 72 hours after co-culturing with the tumor cells. FIG. 48D shows summary data of GFP detection, a surrogate for live tumor cell number, measured as a percent of baseline GFP detection (as of time zero).

Figure 49A:
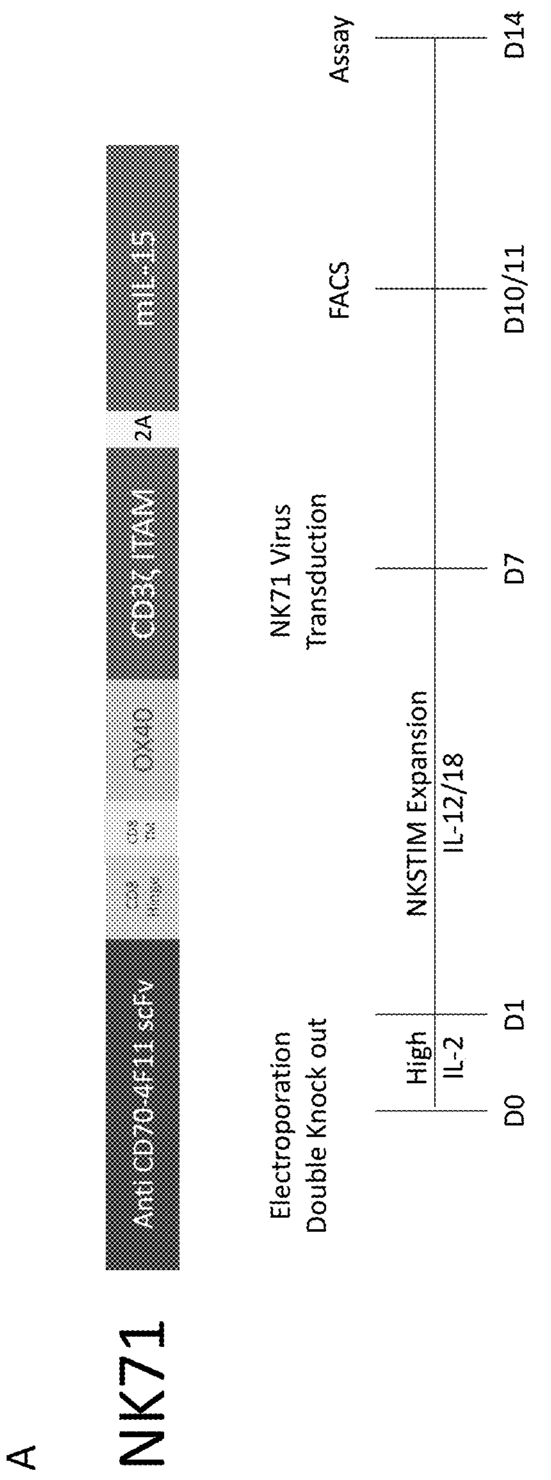
Figure 49B:
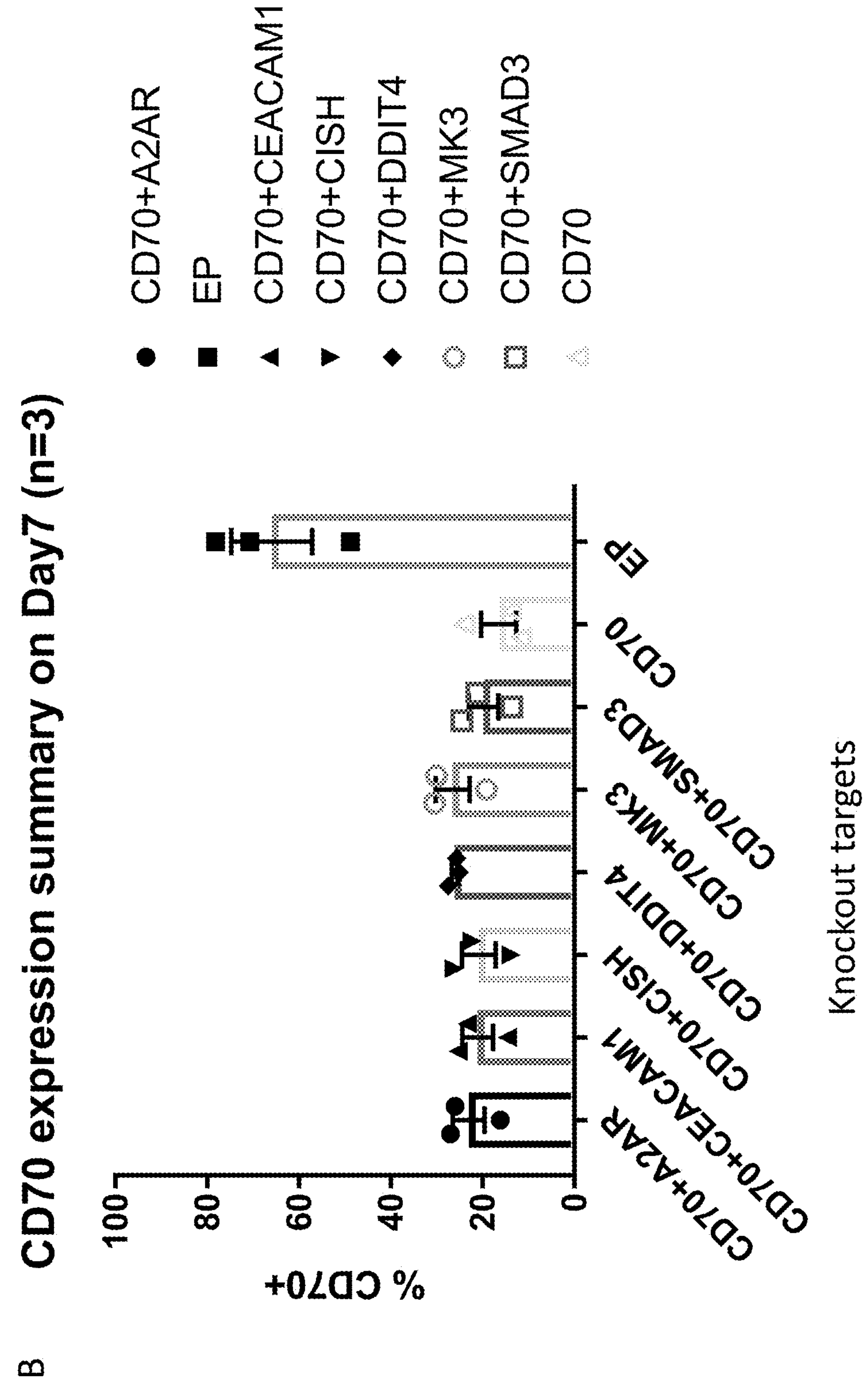
Figure 49C:
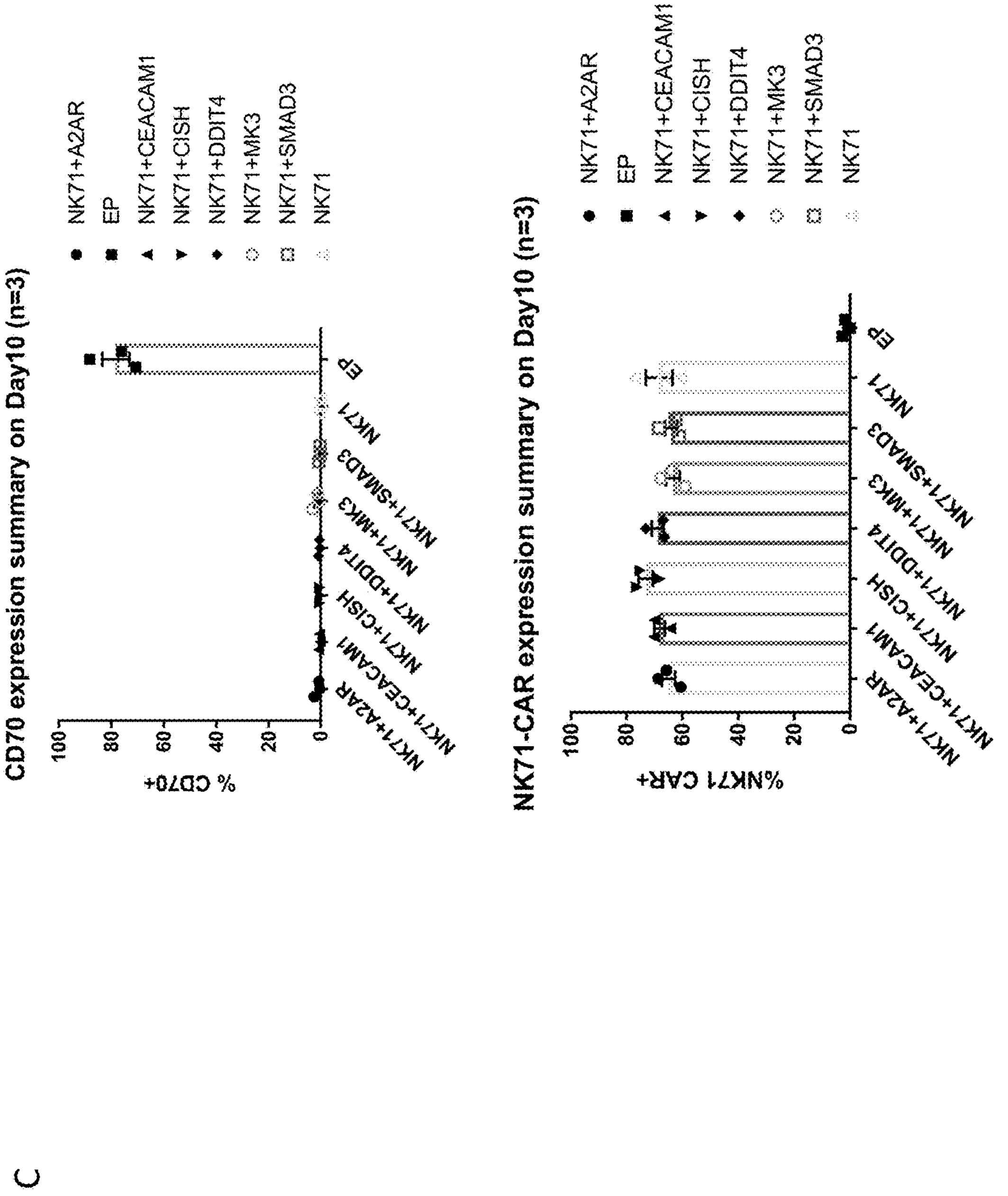
Figure 49D:
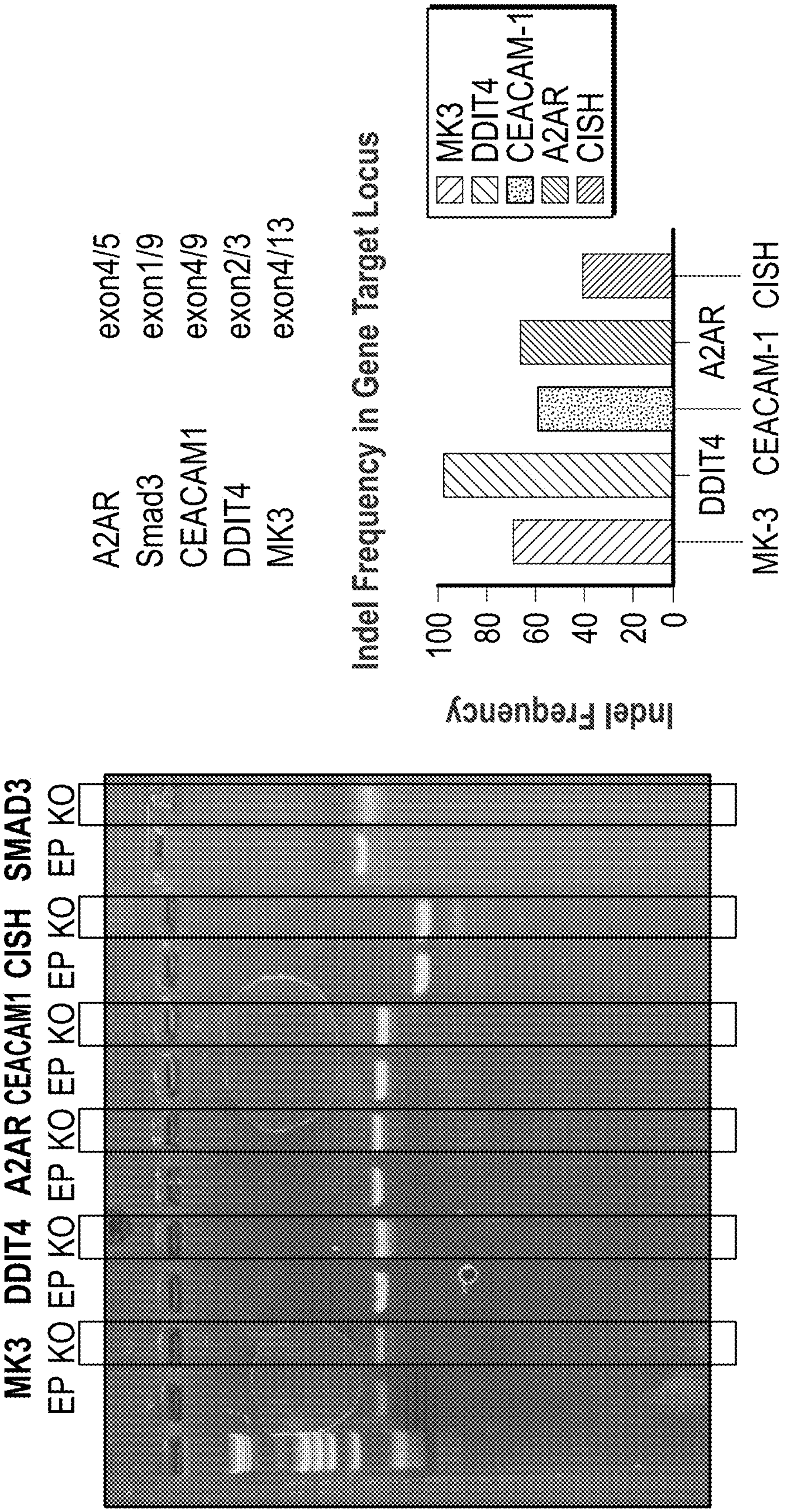

FIGS. 49A-49D show schematics and knockout data from additional various gene edited NK cells that are also engineered to express an anti-CD70 CAR against tumor cells. FIG. 49A shows the schematic where NK cells are first gene edited (e.g. with CRISPR) to knock out both CD70 and a target gene, expanded, and transduced with the NK71 anti-CD70 CAR construct (which is a non-limiting example of a CAR according to the present disclosure), which are then assayed for tumor killing efficacy. FIG. 49B shows consistent percent CD70 expression on day 7 following CD70 and target gene double knockout for different target gene conditions. FIG. 49C shows essentially undetectable CD70 expression on day 10 following double CD70 and target gene double knockout and consistent expression of the non-limiting NK71 CAR in different target gene conditions. FIG. 49D shows PCR amplification data of target gene loci for knockout NK cell populations and indel frequency of amplicons.

Figure 49E:
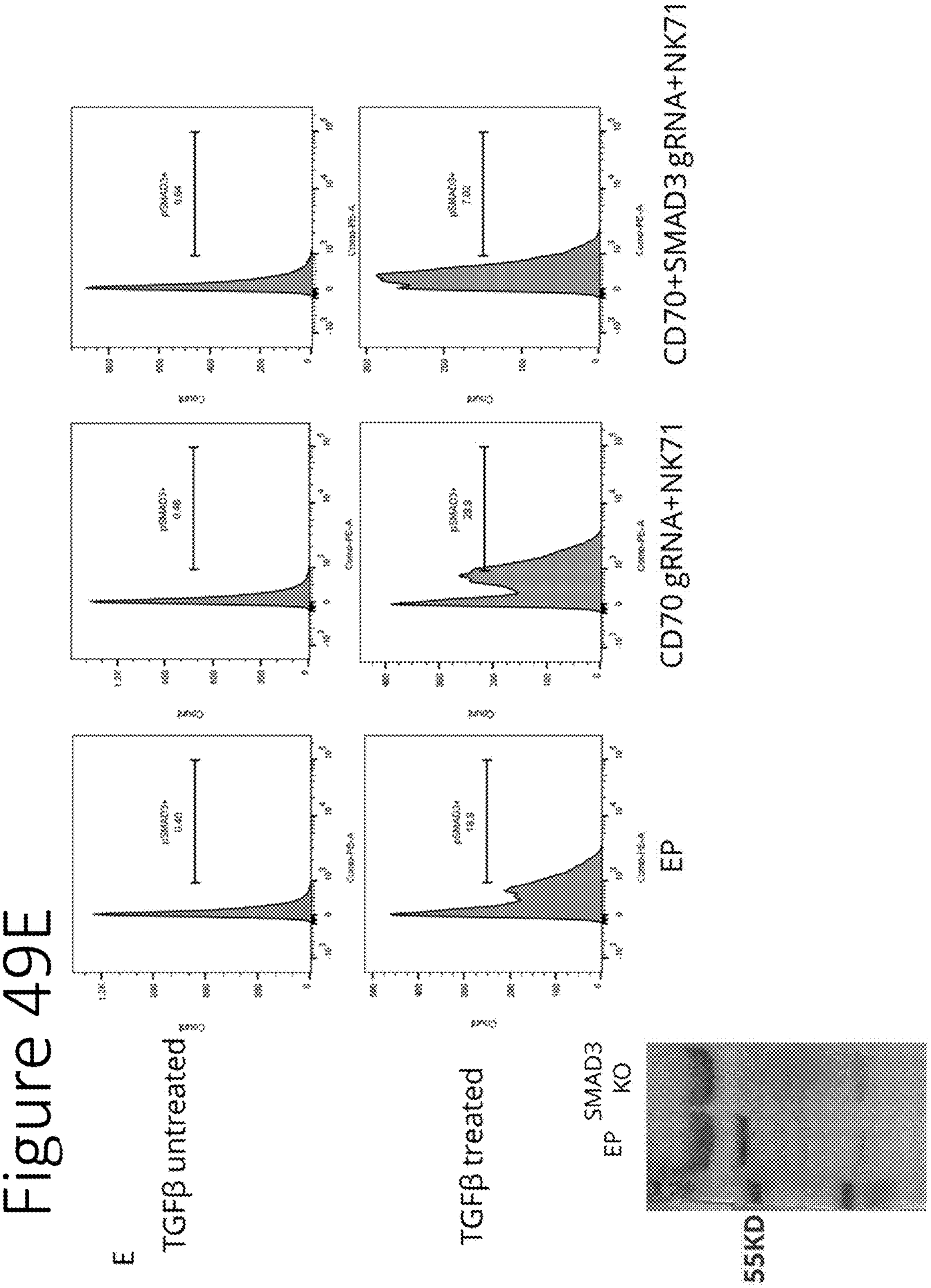
Figure 49F:
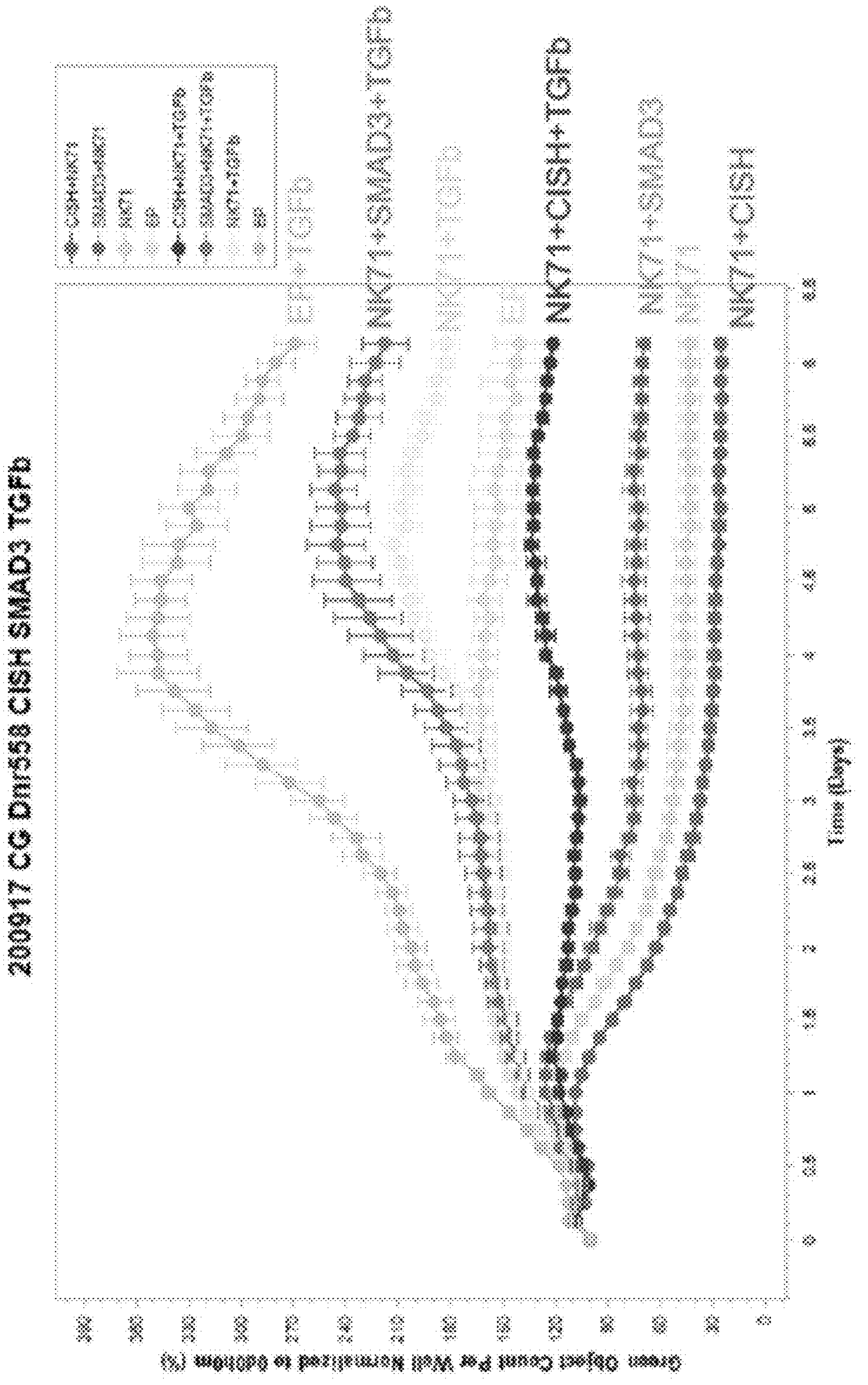
Figure 49G:
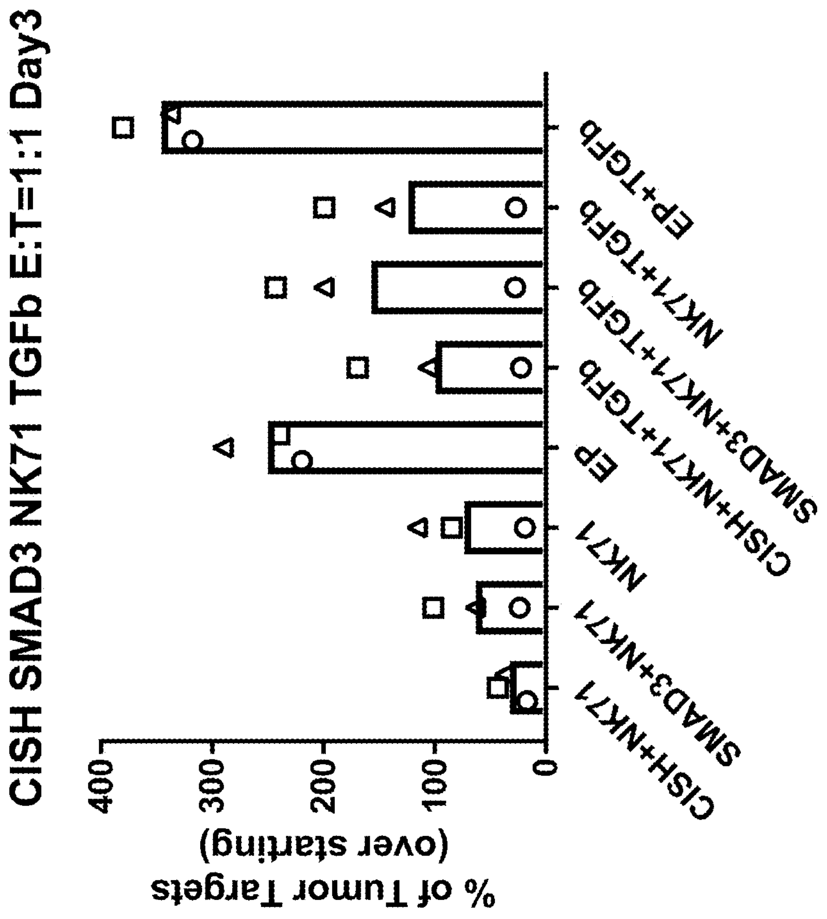

FIGS. 49E-49G show cytotoxicity data for NK cells gene edited for SMAD3. FIG. 49E shows successful knockout of SMAD3 in an NK cell population. FIG. 49F shows cytotoxicity data from SMAD3 or CISH gene edited NK cells expressing the NK71 CAR, against 786-O cells at a 1:4 ratio, with or without treatment with 20 ng/mL TGFb, for up to 6.5 days. FIG. 49G shows the percentage of remaining 786-O cells relative to starting amount after 3 days following treatment with SMAD3 or CISH gene edited NK cells expressing a non-limiting example of a CAR, NK71, at a 1:1 ratio, with or without treatment with 20 ng/mL TGFb.

Figure 49H:
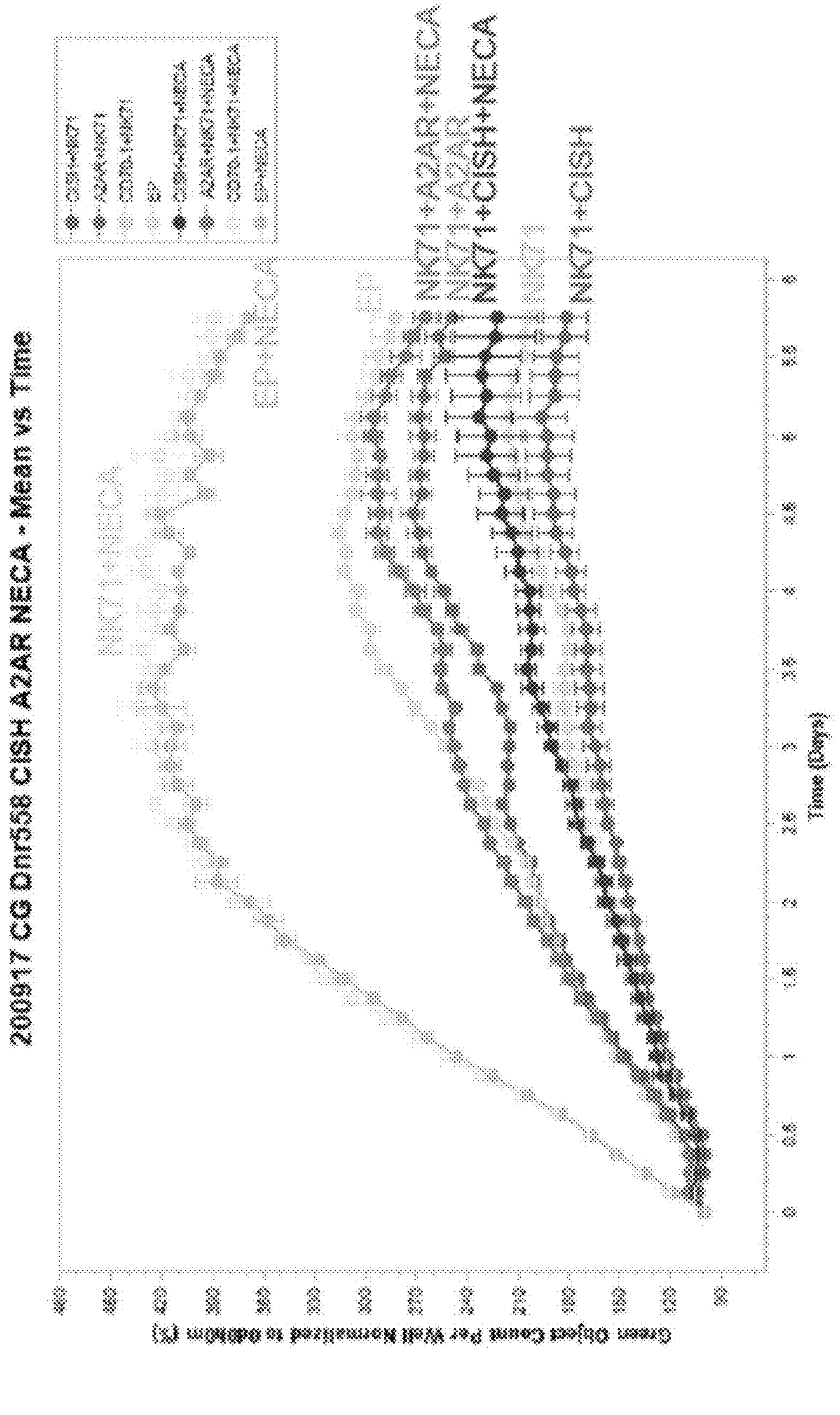
Figure 49I:
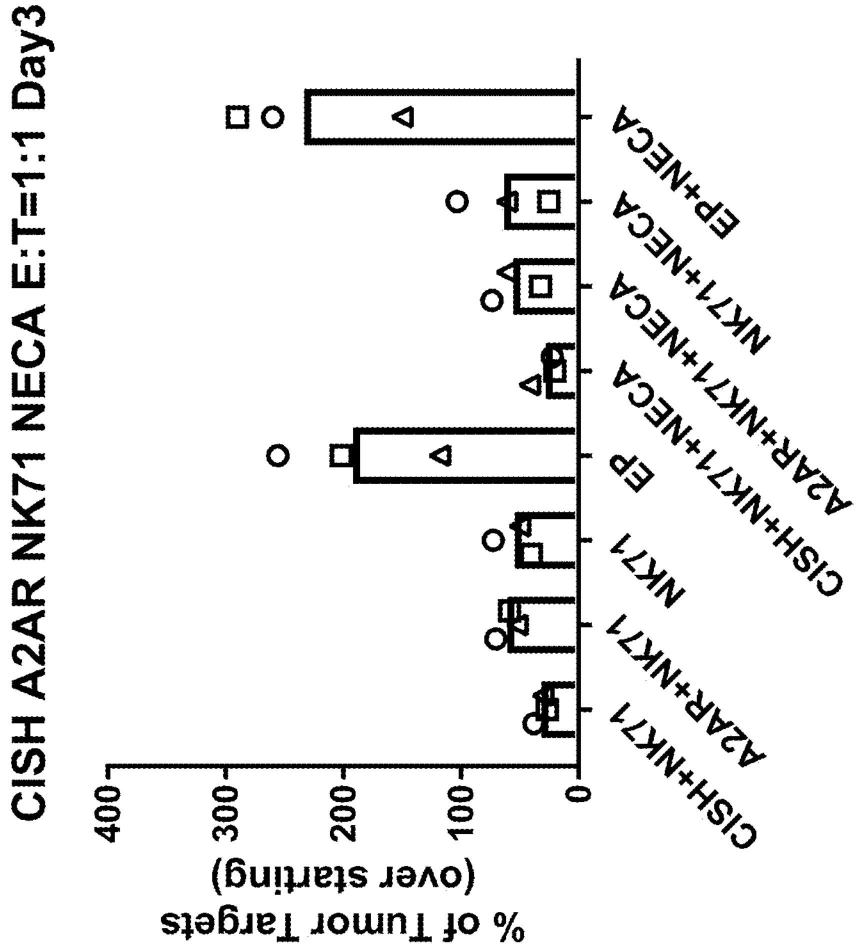

FIGS. 49H-49I show cytotoxicity data for NK cells gene edited for A2AR. FIG. 49H shows cytotoxicity data from A2AR or CISH gene edited NK cells expressing the NK71 CAR against 786-O cells at a 1:4 ratio, with or without treatment with 10 μM NECA, for up to 6 days. FIG. 49I shows the percentage of remaining 786-O cells relative to starting amount after 3 days following treatment with A2AR or CISH gene edited NK cells expressing the NK71 CAR at a 1:1 ratio, with or without treatment with 10 μM NECA.

Figure 49J:
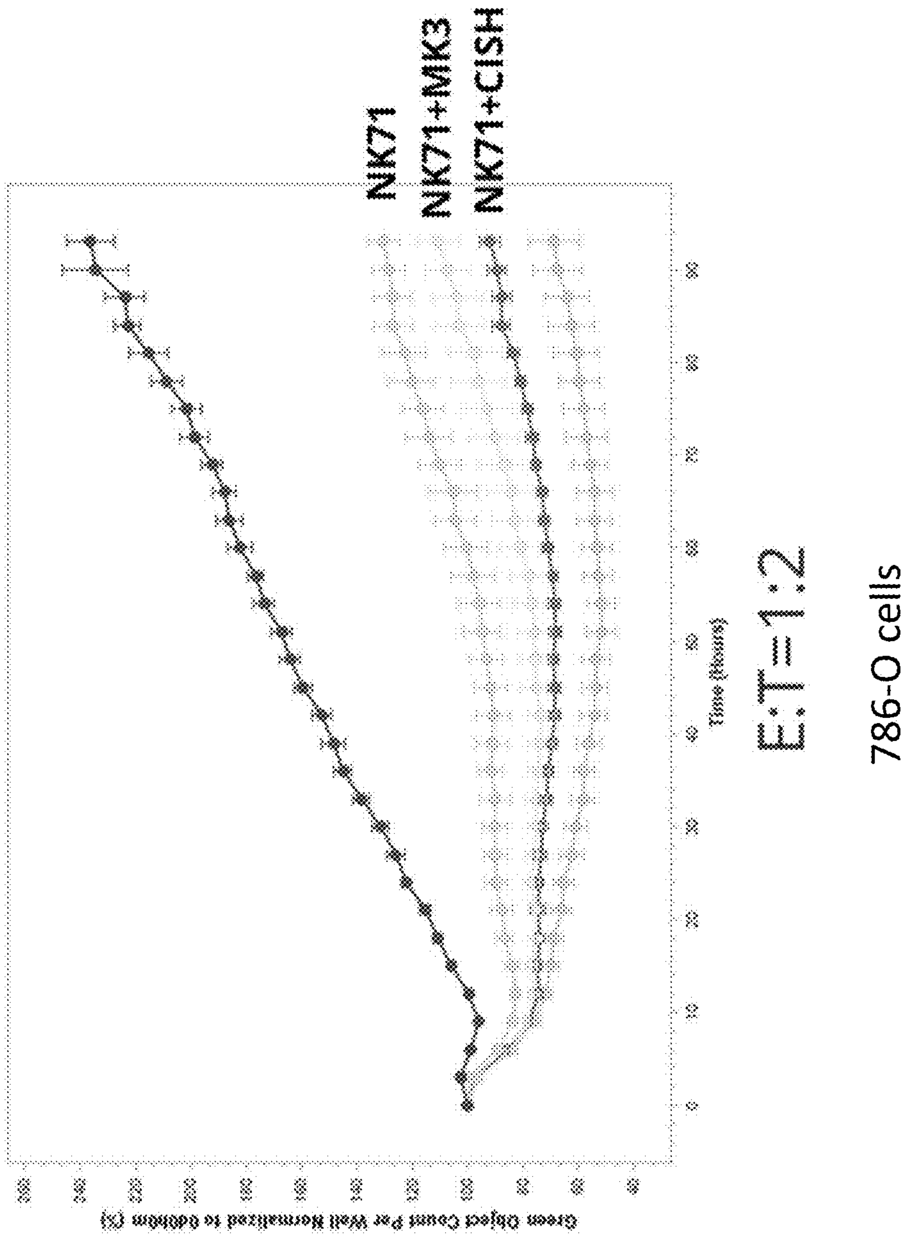
Figure 49K:
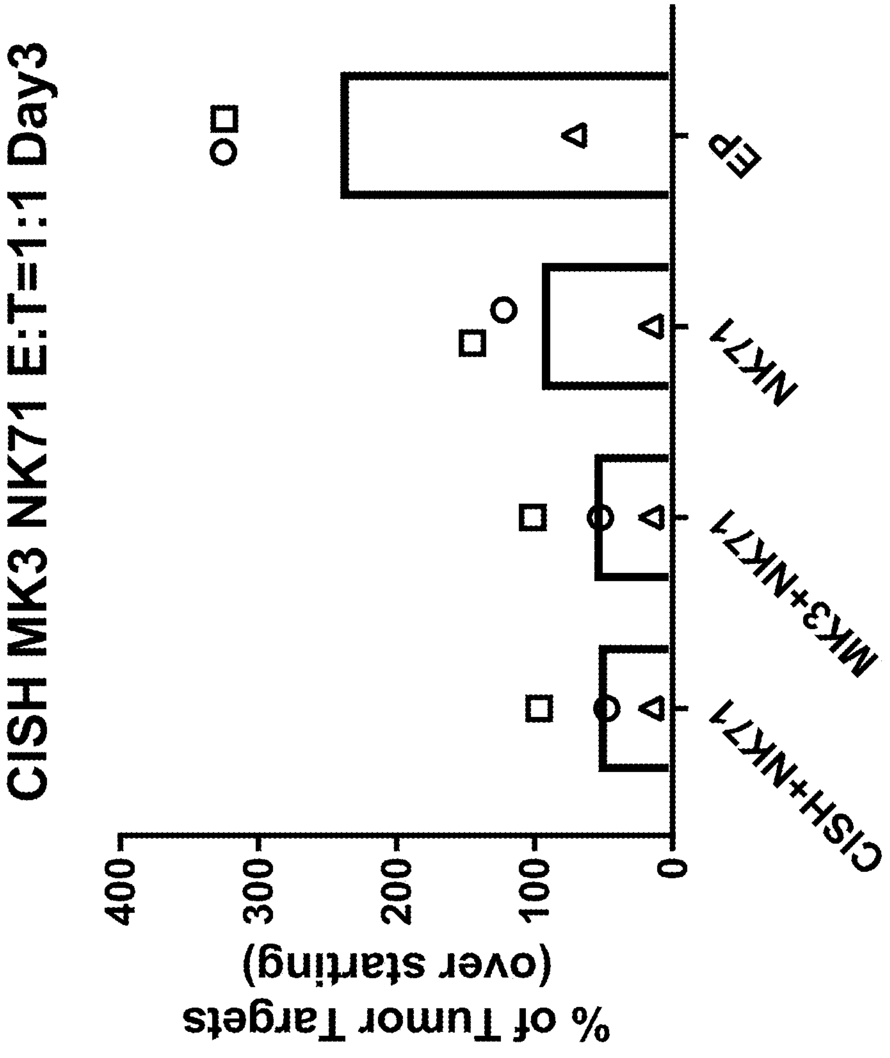

FIGS. 49J-49K show cytotoxicity data for NK cells gene edited for MAPKAPK3. FIG. 49J shows cytotoxicity data from MAPKAPK3 (MK3) or CISH gene edited NK cells expressing the NK71 CAR against 786-O cells at a 1:2 ratio, for up to 94 hours. FIG. 49K shows the percentage of remaining 786-O cells relative to starting amount after 3 days following treatment with MK3 or CISH gene edited NK cells expressing the NK71 CAR at a 1:1 ratio.

Figure 49L:
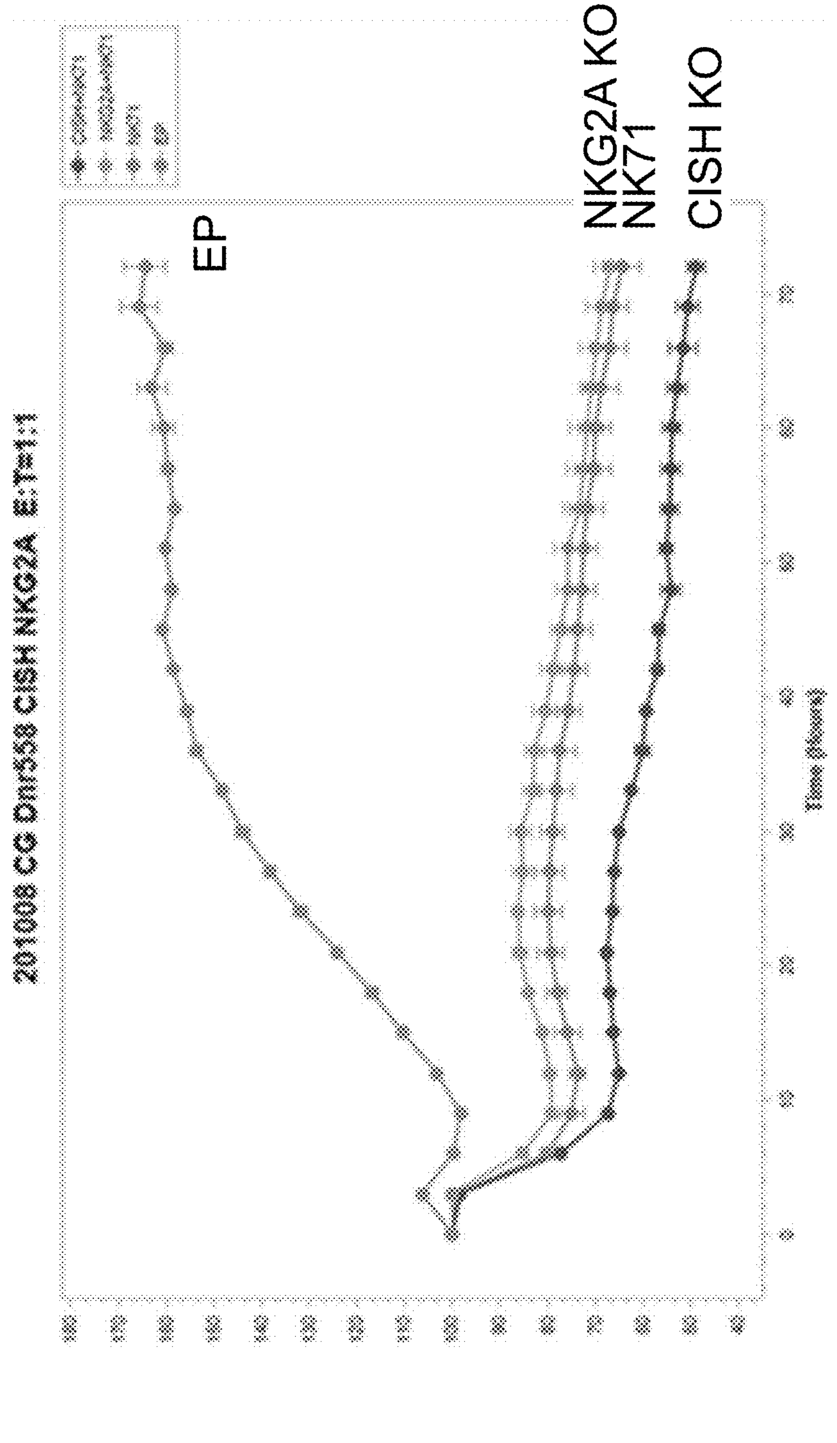
Figure 49M:
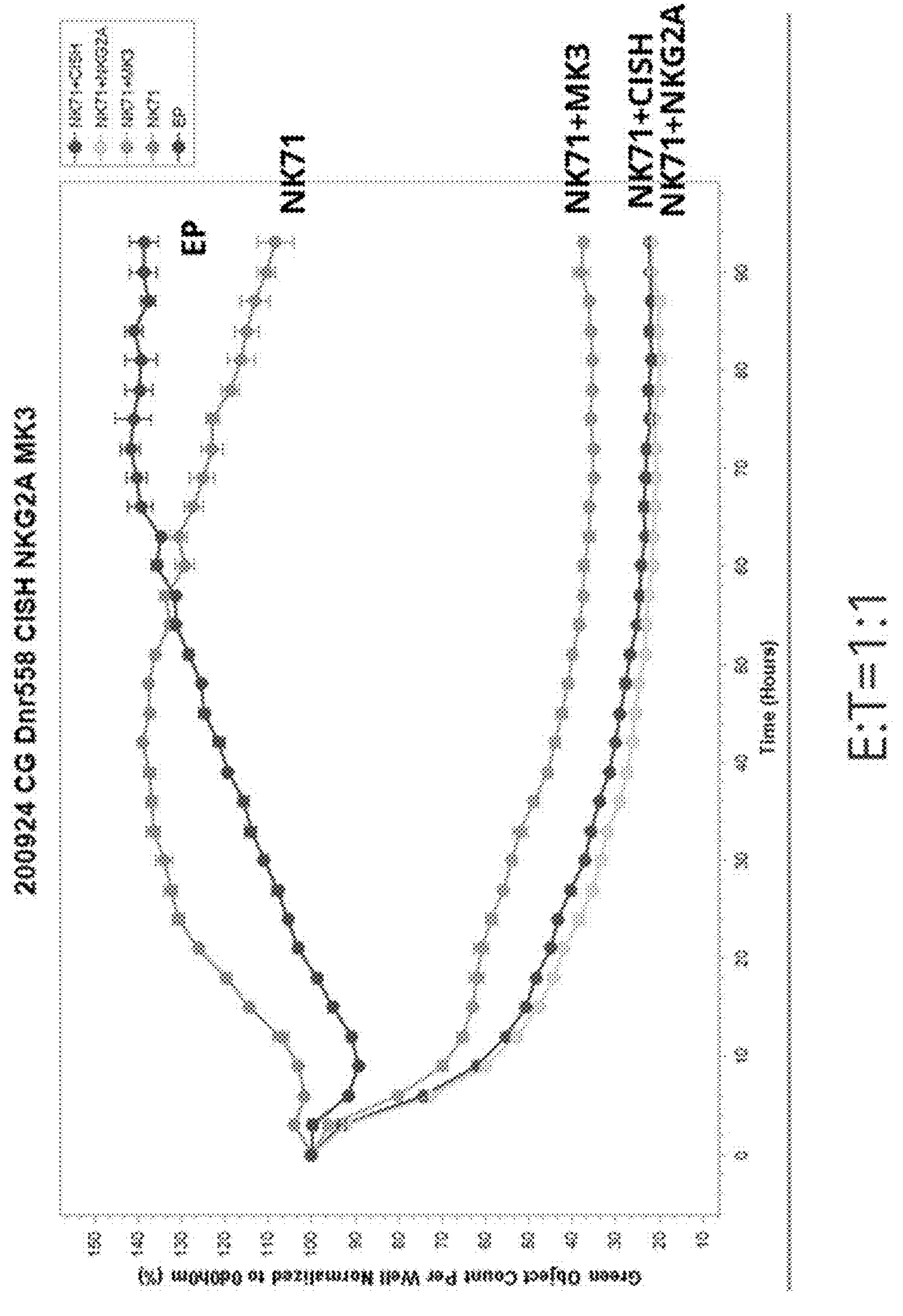
Figure 49N:
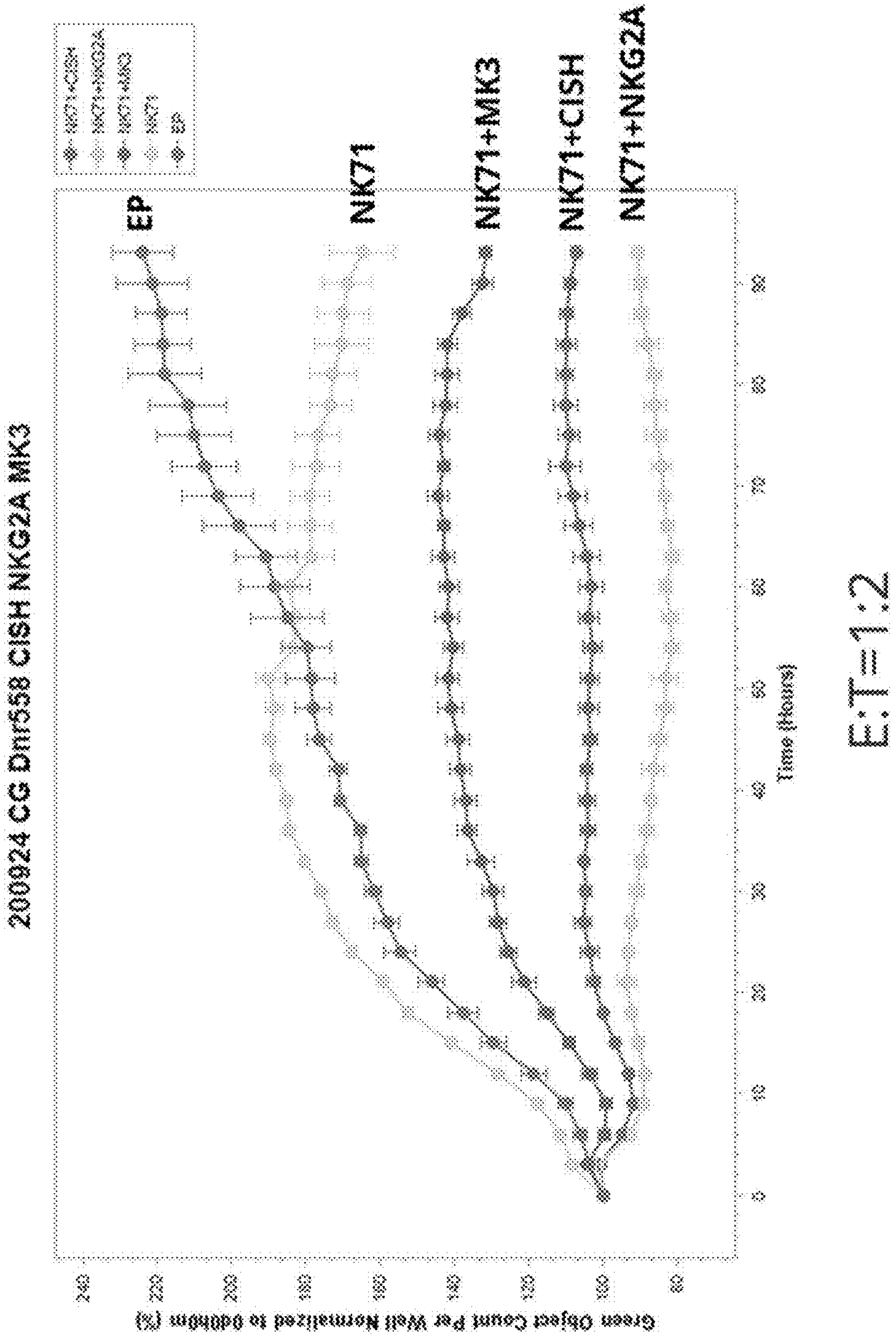
Figure 490:
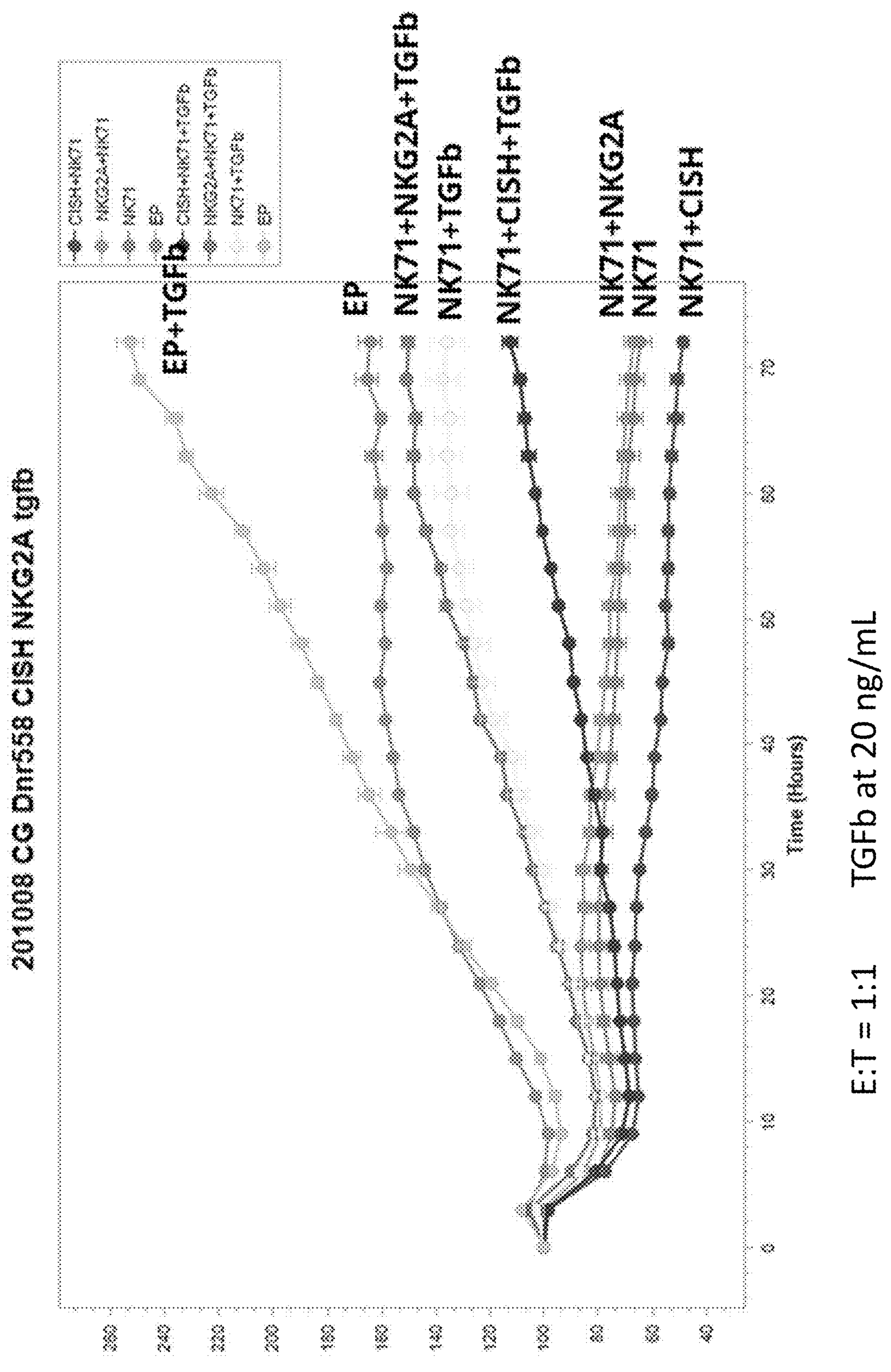
Figure 49P:
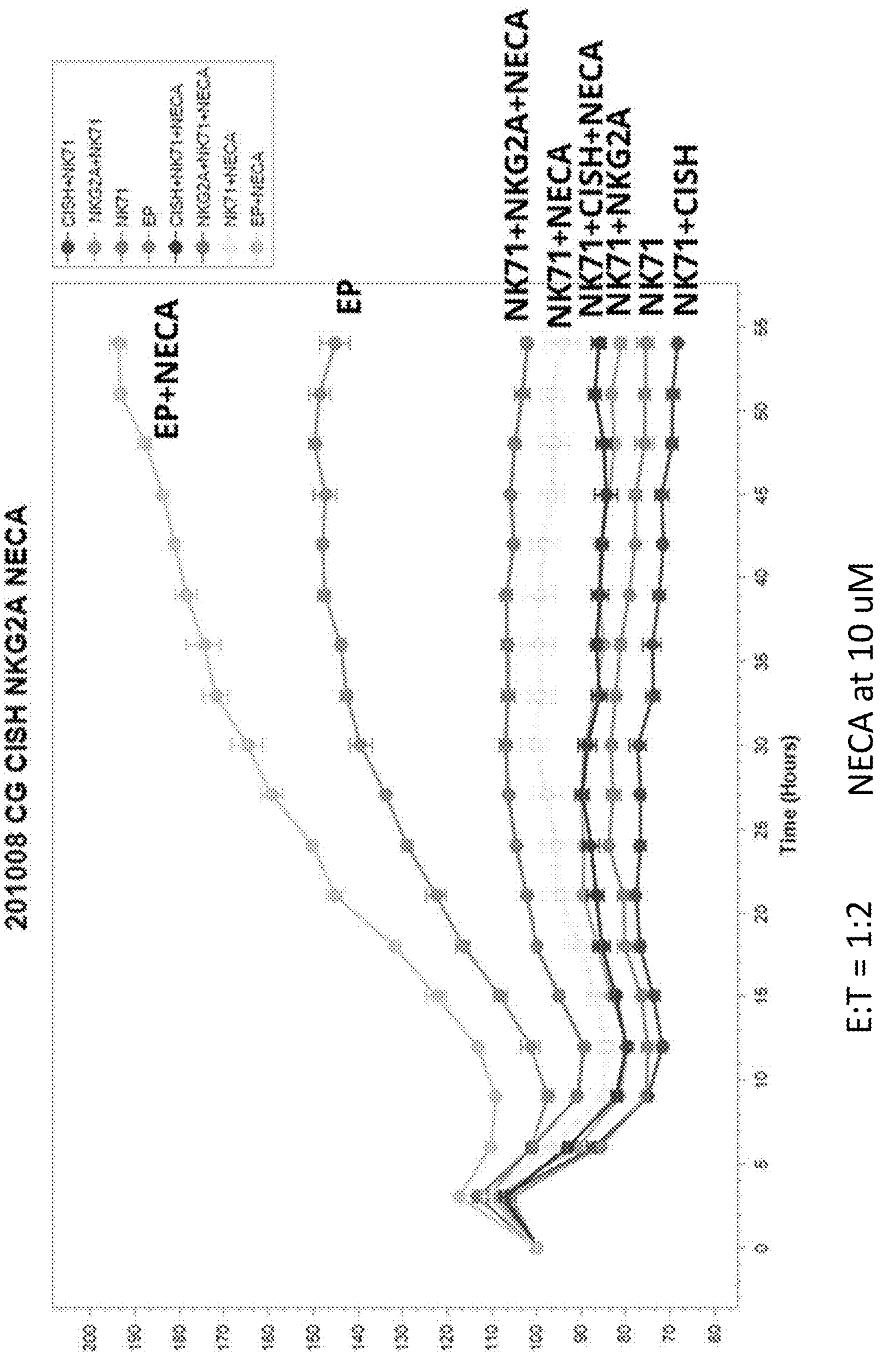

FIGS. 49L-49P show cytotoxicity data for NK cells gene edited for NKG2A. FIG. 49L shows cytotoxicity data from NKG2A or CISH gene edited NK cells expressing the NK71 CAR against 786-O cells at a 1:1 ratio, for up to 72 hours. FIG. 49M shows cytotoxicity data from NKG2A, MK3, or CISH gene edited NK cells expressing the NK71 CAR against 786-O cells at a 1:1 ratio, for up to 94 hours. FIG. 49N shows cytotoxicity data from NKG2A, MK3, or CISH gene edited NK cells expressing the NK71 CAR against 786-O cells at a 1:2 ratio, for up to 94 hours. FIG. 49O shows cytotoxicity data from NKG2A or CISH gene edited NK cells expressing the NK71 CAR against 786-O cells at a 1:1 ratio, with or without treatment with 20 ng/mL TGFb, for up to 72 hours. FIG. 49P shows cytotoxicity data from NKG2A or CISH gene edited NK cells expressing the NK71 CAR against 786-O cells at a 1:2 ratio, with or without treatment with 10 μM NECA, for up to 54 hours.

Figure 49Q:
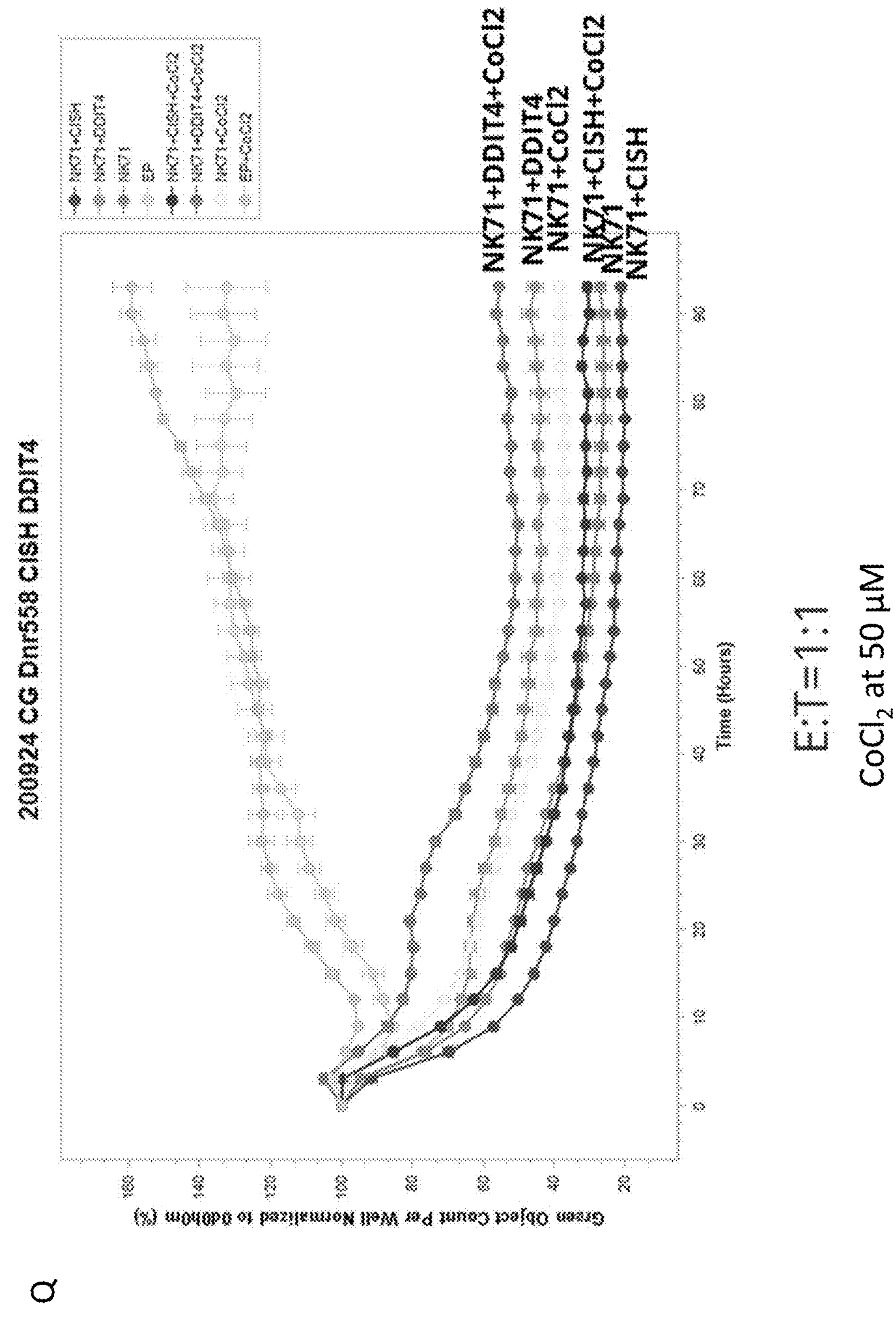
Figure 49R:
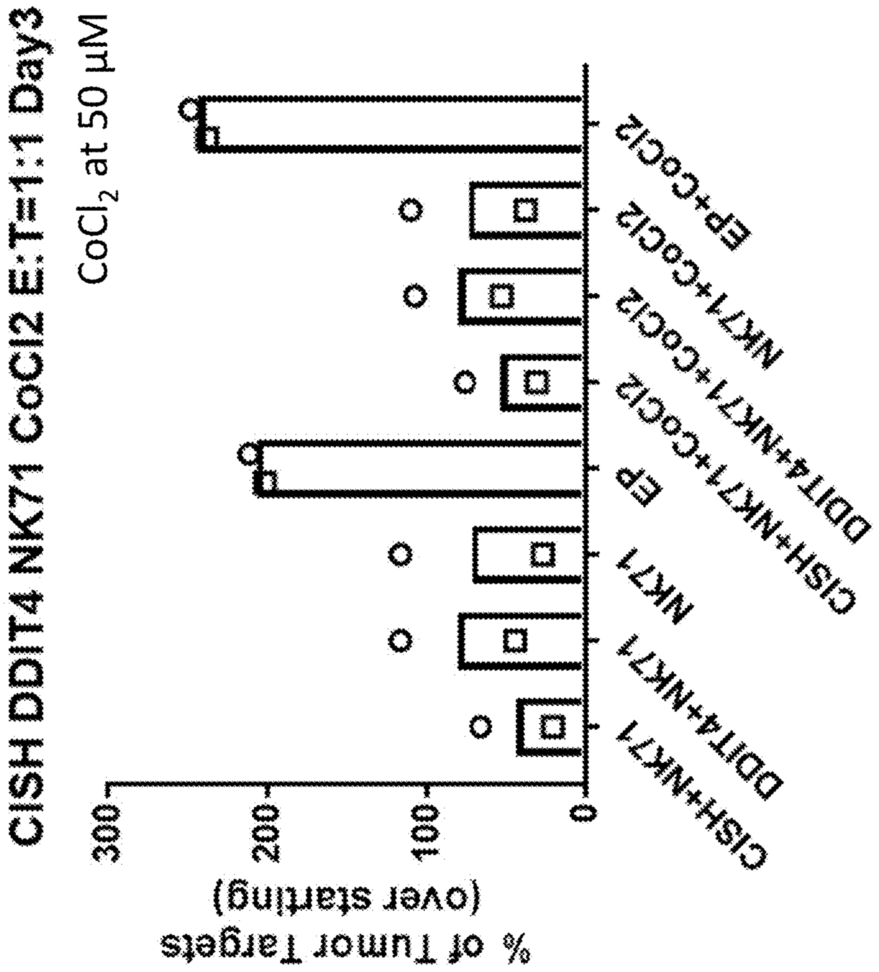

FIGS. 49Q-49R show cytotoxicity data for NK cells gene edited for DDIT4. FIG. 49Q shows cytotoxicity data from DDIT4 or CISH gene edited NK cells expressing the NK71 CAR against 786-O cells at a 1:1 ratio, with or without treatment with 50 μM $CoCl_2$, for up to 94 hours. FIG. 49R shows the percentage of remaining 786-O cells relative to starting amount after 3 days following treatment with DDIT4 or CISH gene edited NK cells expressing the NK71 CAR at a 1:1 ratio, with or without treatment with 50 μM $CoCl_2$.

Figure 49S:
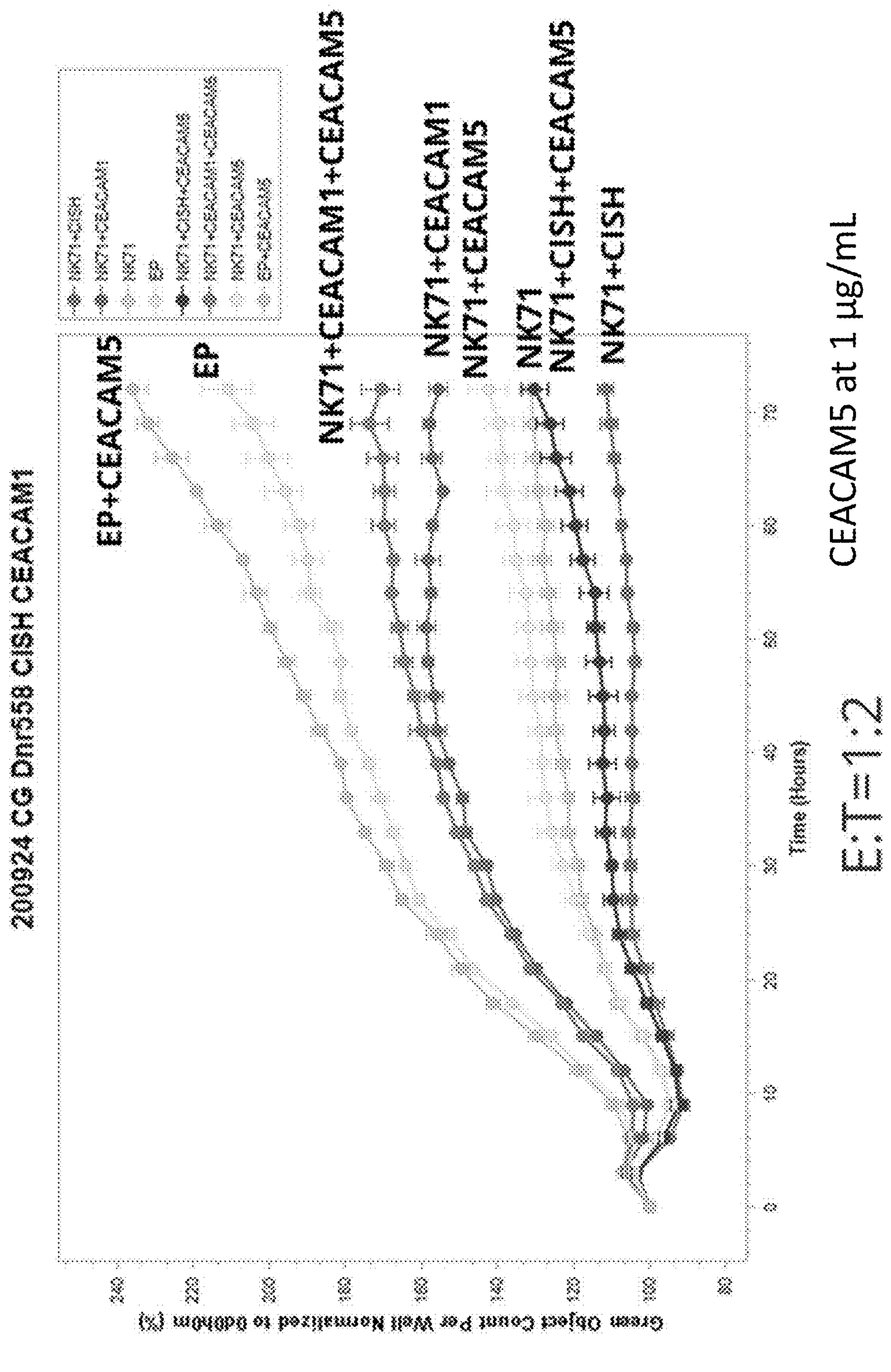
Figure 49T:
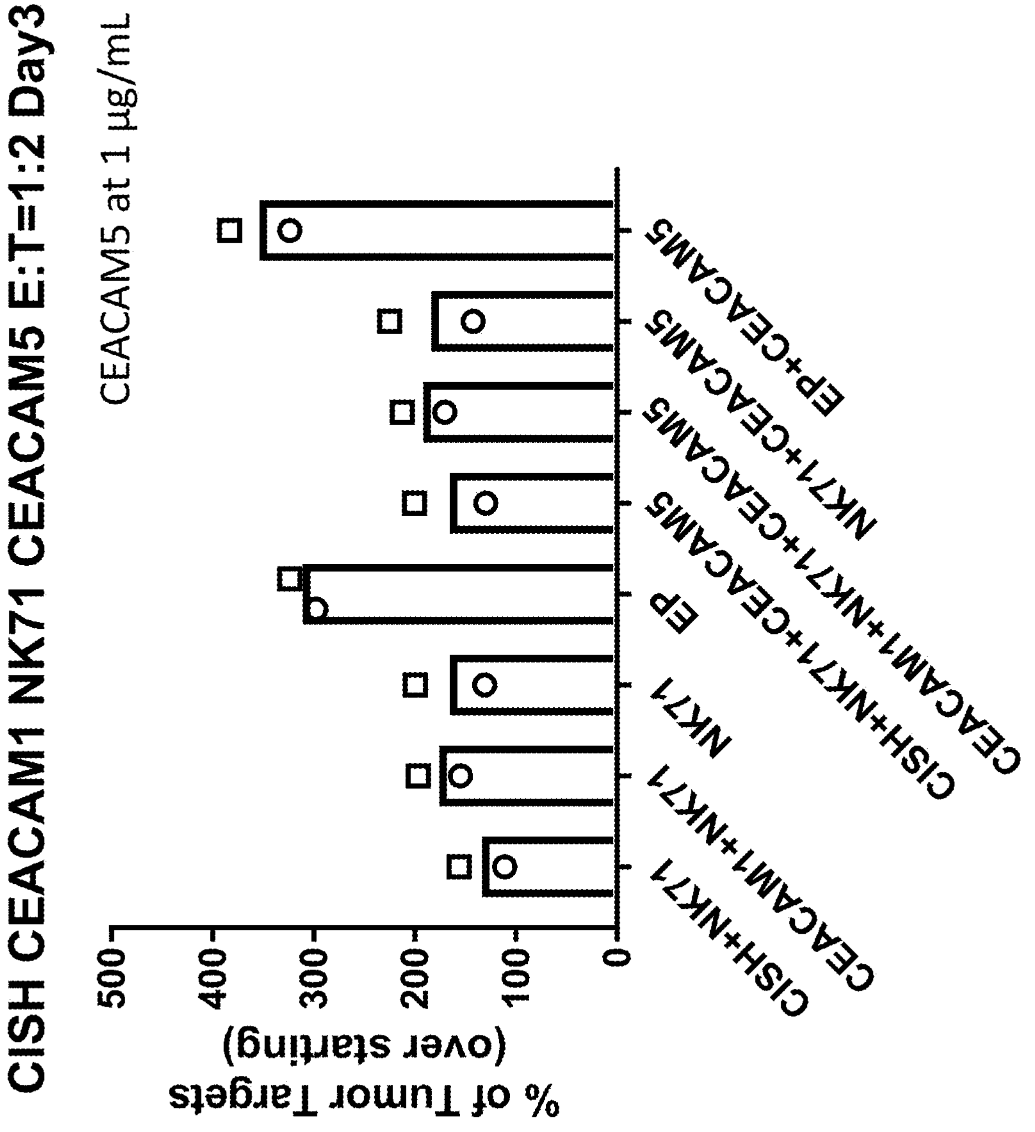

FIGS. 49S-49T show cytotoxicity data for NK cells gene edited for CEACAM1. FIG. 49S shows cytotoxicity data from CEACAM1 or CISH gene edited NK cells expressing the NK71 CAR against 786-O cells at a 1:2 ratio, with or without treatment with 1 μg/mL CEACAM5, for up to 72 hours.

FIG. 49T shows the percentage of remaining 786-O cells relative to starting amount after 3 days following treatment with CEACAM1 or CISH gene edited NK cells expressing the NK71 CAR at a 1:2 ratio, with or without treatment with 1 μg/mL CEACAM5.

Figure 49U:
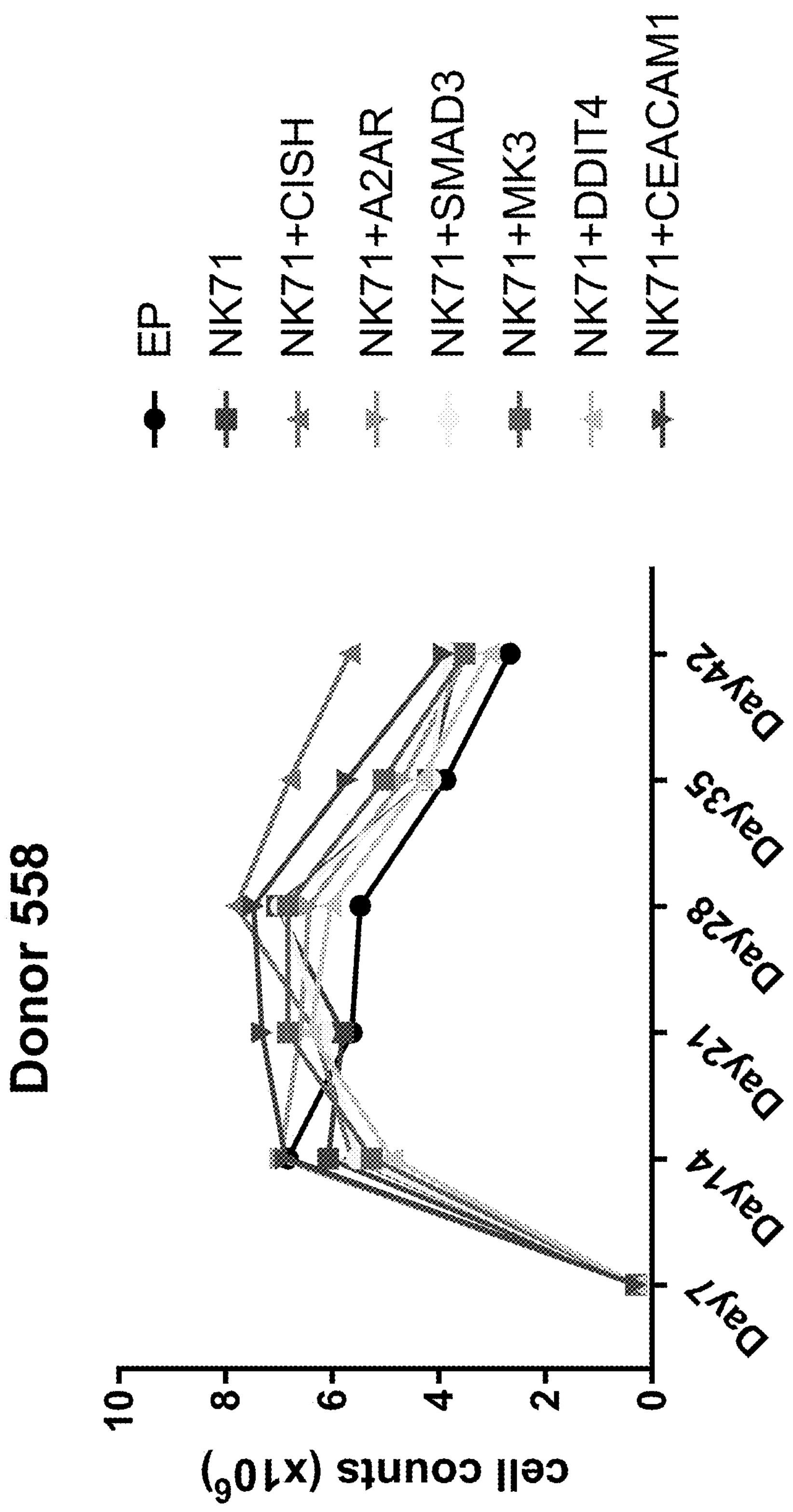
Figure 49V:
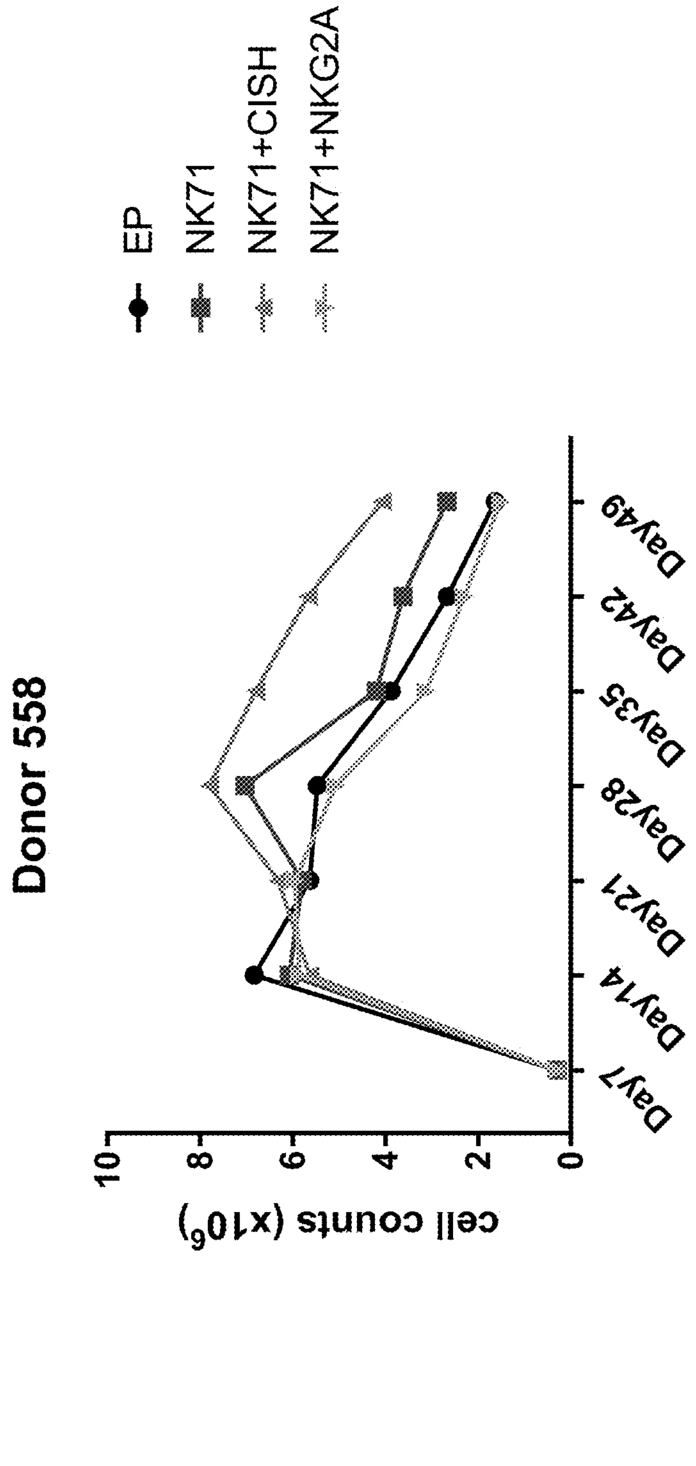

FIGS. 49U and 49V show survival over 49 days for NK cells expressing the NK71 CAR that have been gene edited for CD70 and the various indicated gene targets.

FIG. 50A depicts exemplary heavy chain variable region (VH) and light chain variable region (VL) peptide and nucleic acid sequences for the selected anti-CD70 scFvs disclosed herein. The sequences disclosed herein may be used for any of the embodiments disclosed herein.

FIG. 50B depicts exemplary heavy chain variable region and light chain variable region complementarity determining regions (CDRs) for the selected anti-CD70 scFvs disclosed herein. In some embodiments, other combinations of CDRs may be used to prepare other anti-CD70 scFvs or other binding domains. The CDRS disclosed herein may be used for any of the embodiments disclosed herein.

Figure 50C:
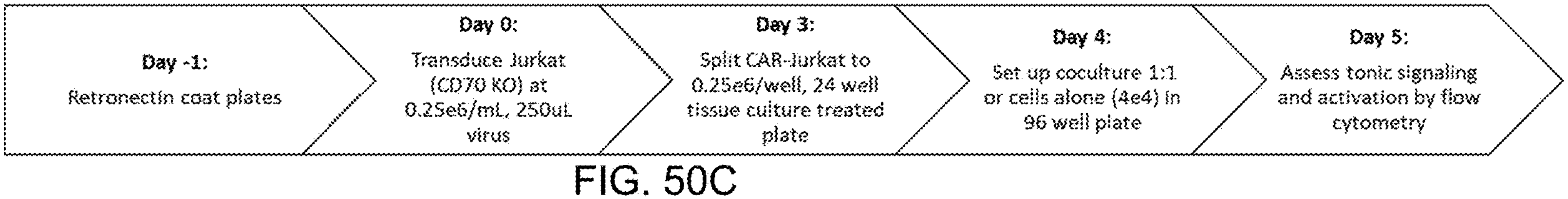

FIG. 50C depicts a schematic for selecting CARs comprising an anti-CD70 binding domain based on tonic signaling and immune cell activation.

Figure 50D:
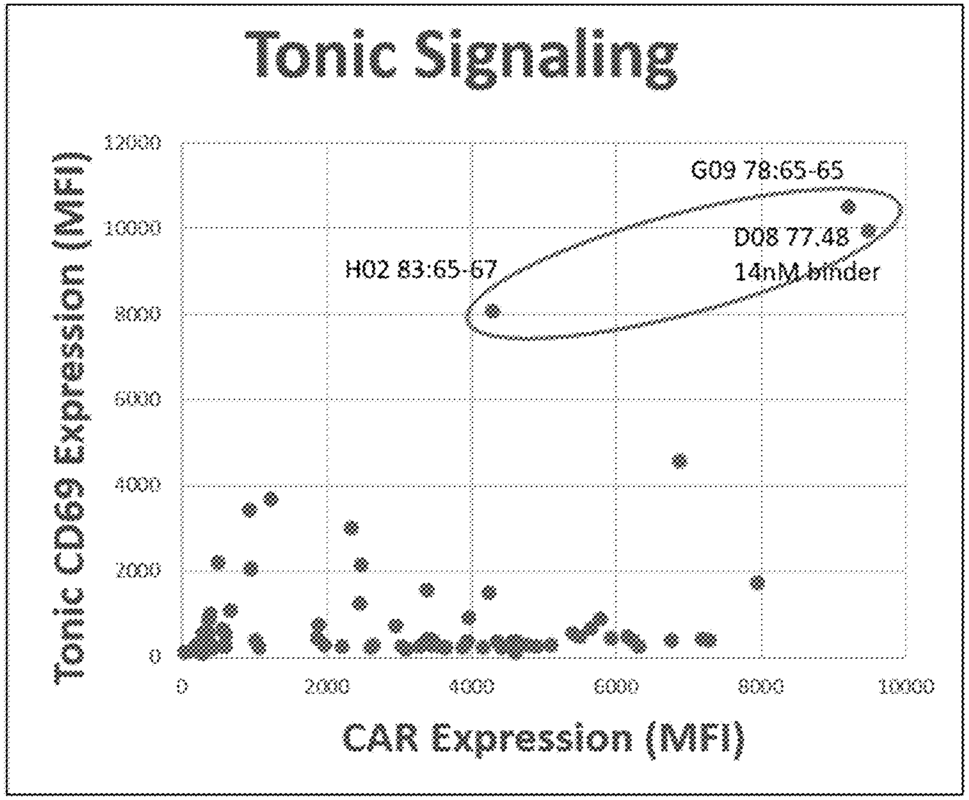

FIG. 50D shows data related detection of the degree of tonic signaling in Jurkat lines.

Figure 50E:
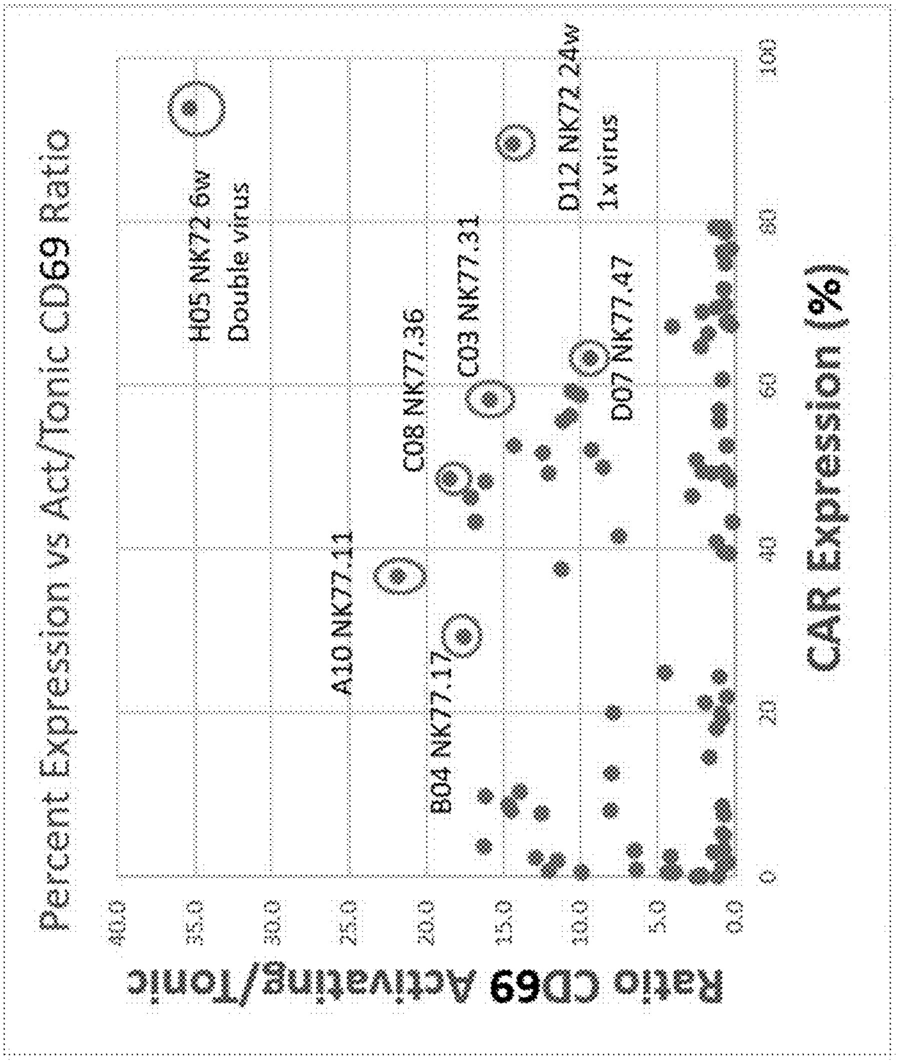

FIG. 50E shows CAR activation relative to tonic signaling further ordered by overall CAR expression in Jurkat cells expressing the disclosed anti-CD70 CARs. The circled points depict selected non-limiting embodiments of anti-CD70 CAR constructs that result in significant on-target activation relative to tonic signaling.

FIG. 50F shows a non-limiting list of 10 anti-CD70 CAR constructs that were selected for having desirable activation and limited/minimal tonic signaling effects in Jurkat cells. These constructs were tested in additional assays disclosed herein.

Figure 51A:
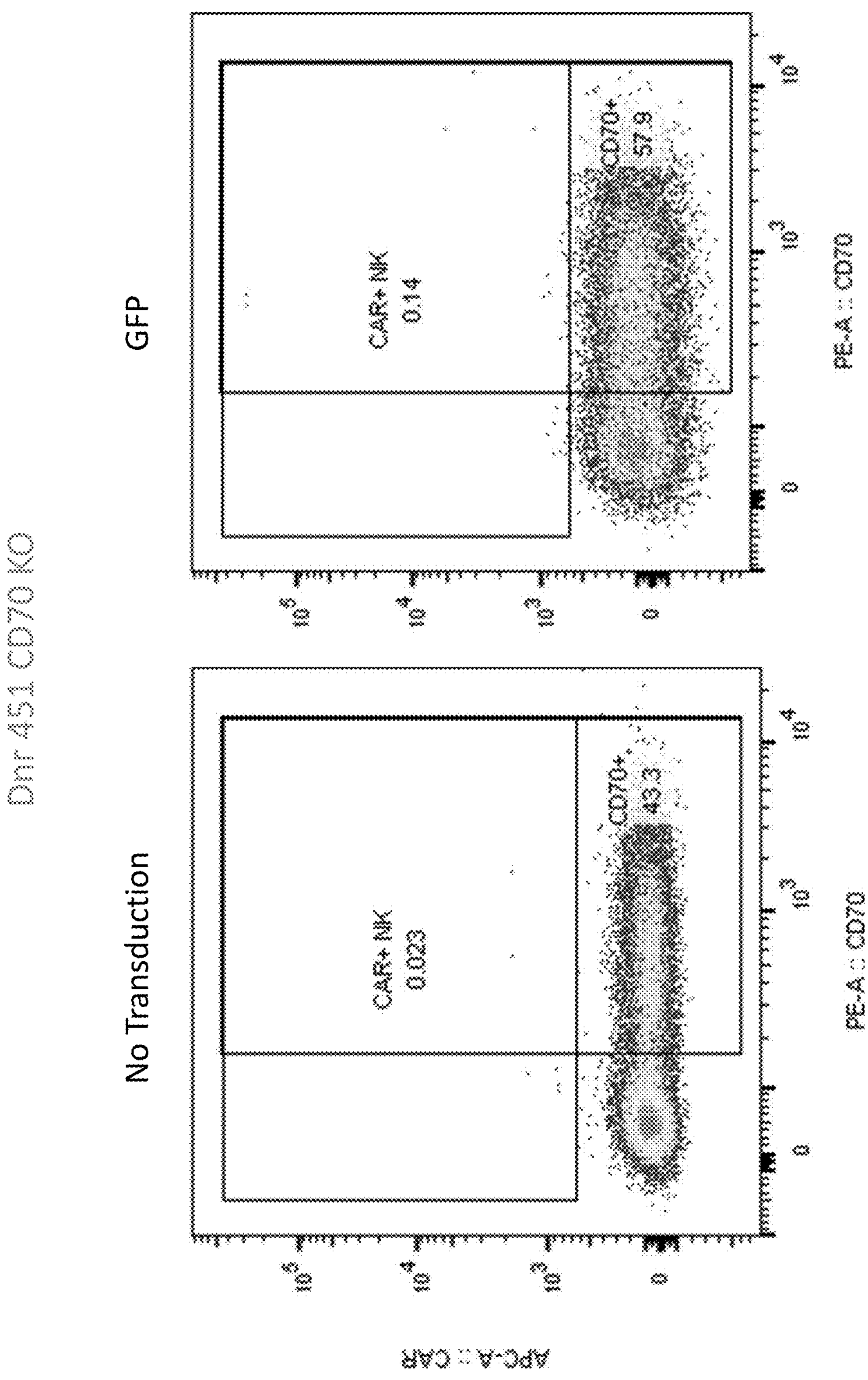
Figure 51A:
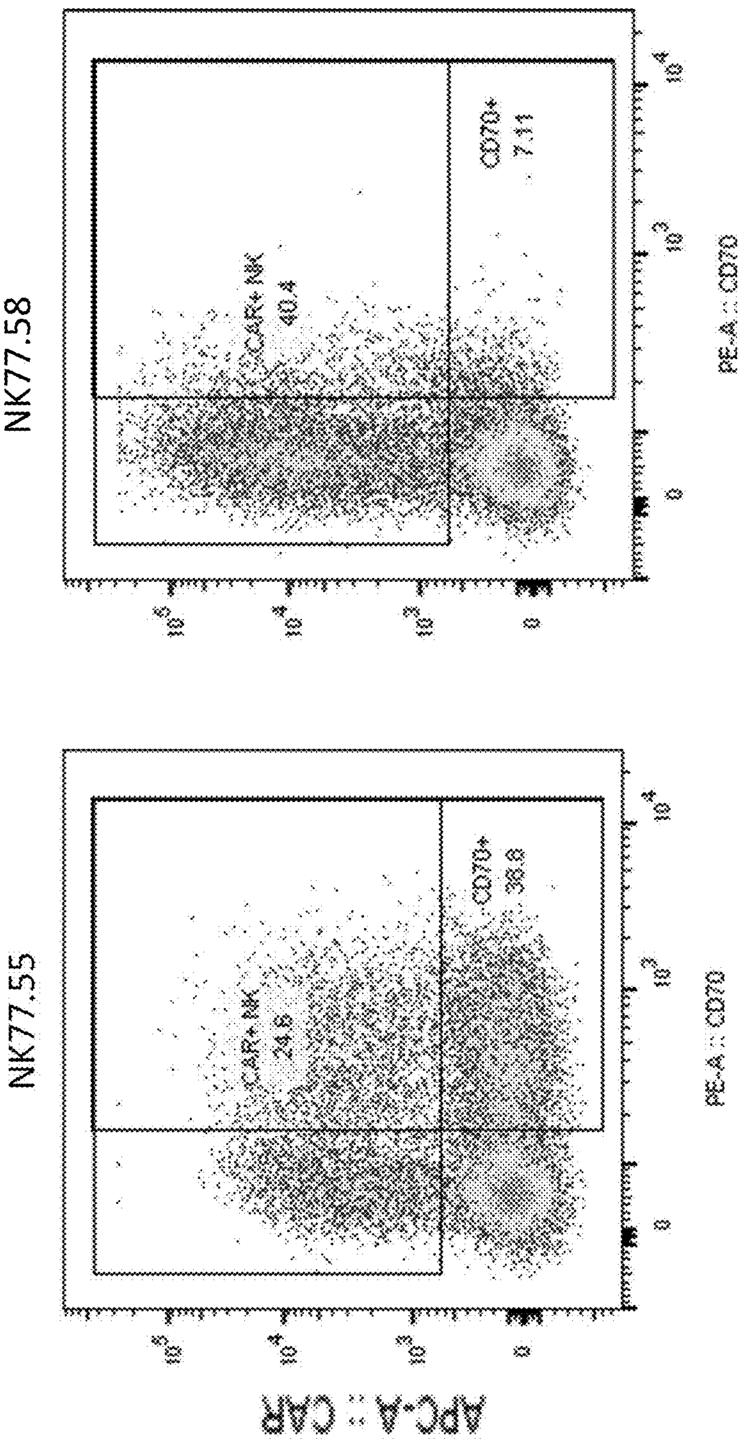
Figure 51A:
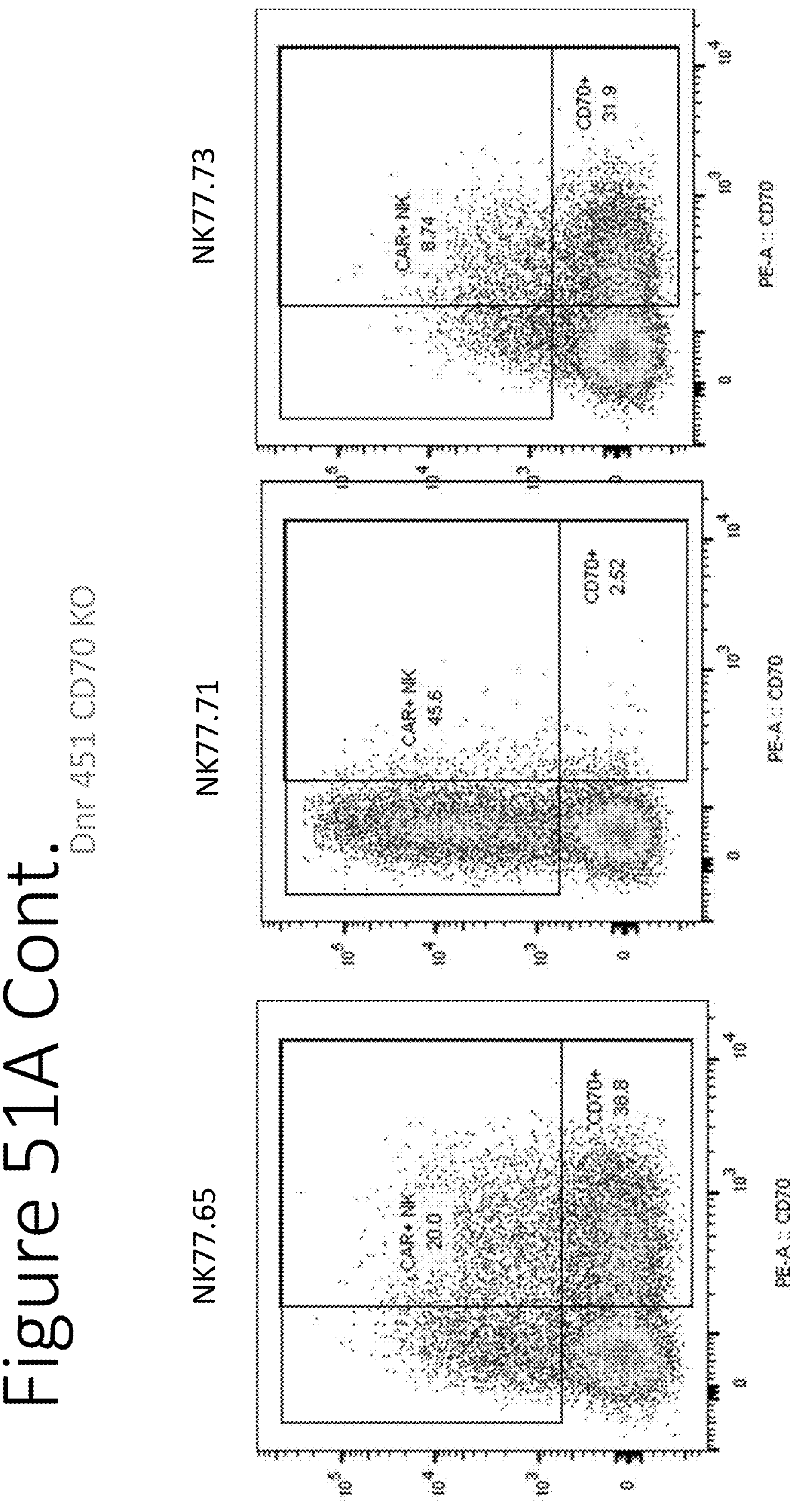

FIGS. 51A-51B shows expression levels of tested anti-CD70 CARs in a donor NK cell population gene edited to knockout CD70. FIG. 51A shows flow cytometry plots detecting expression of the CAR (by anti-FLAG antibody conjugated with allophycocyanin (APC)) and loss of expression of CD70 (by anti-CD70 antibody conjugated with phycoerythrin (PE)). FIG. 51B shows the quantification of anti-CD70 CAR and CD70 expression in the NK cell population of FIG. 51A. NK8 refers to a control construct that expresses GFP instead of a CAR/mbIL15.

Figure 52A:
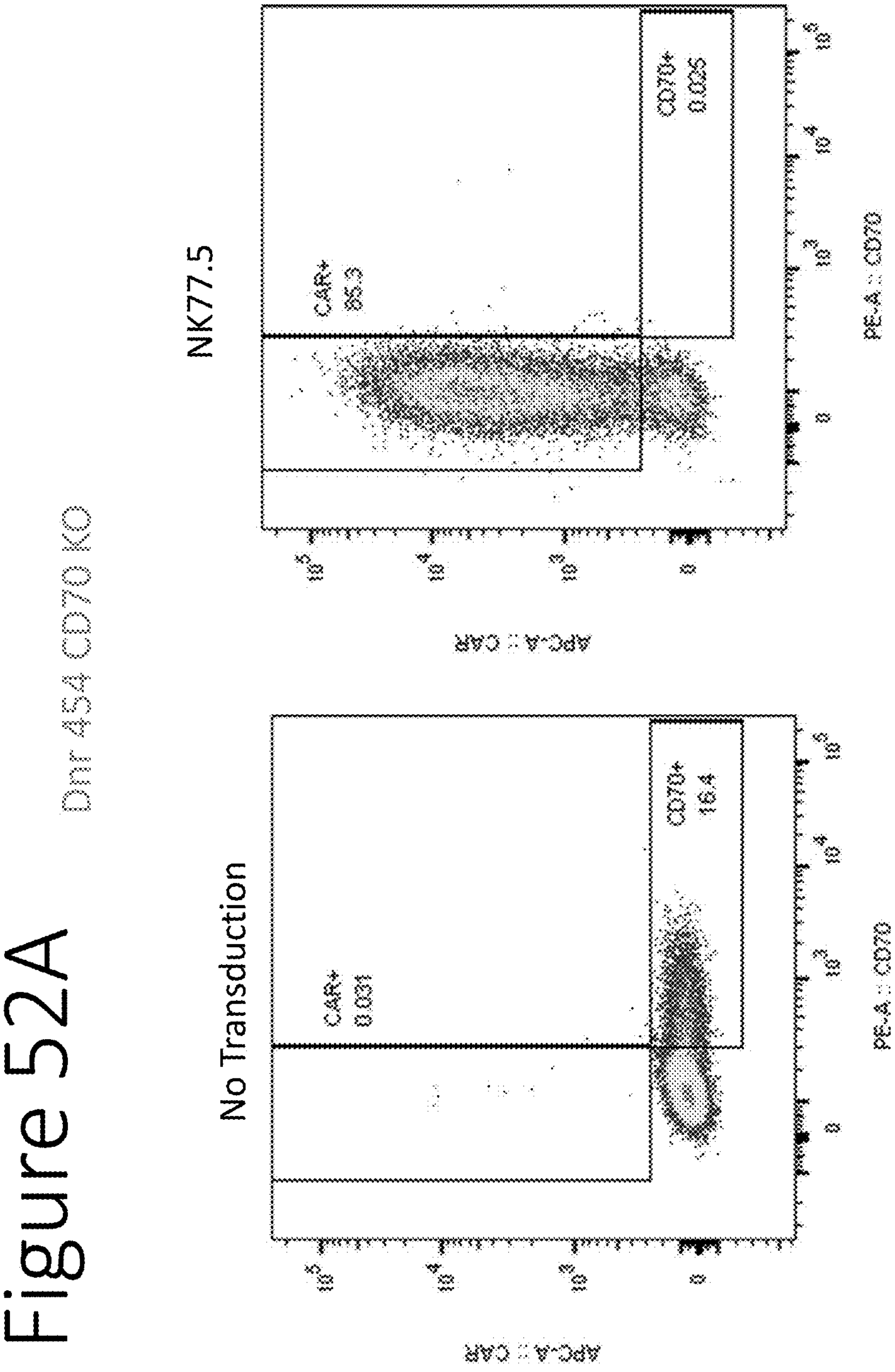
Figure 52A:
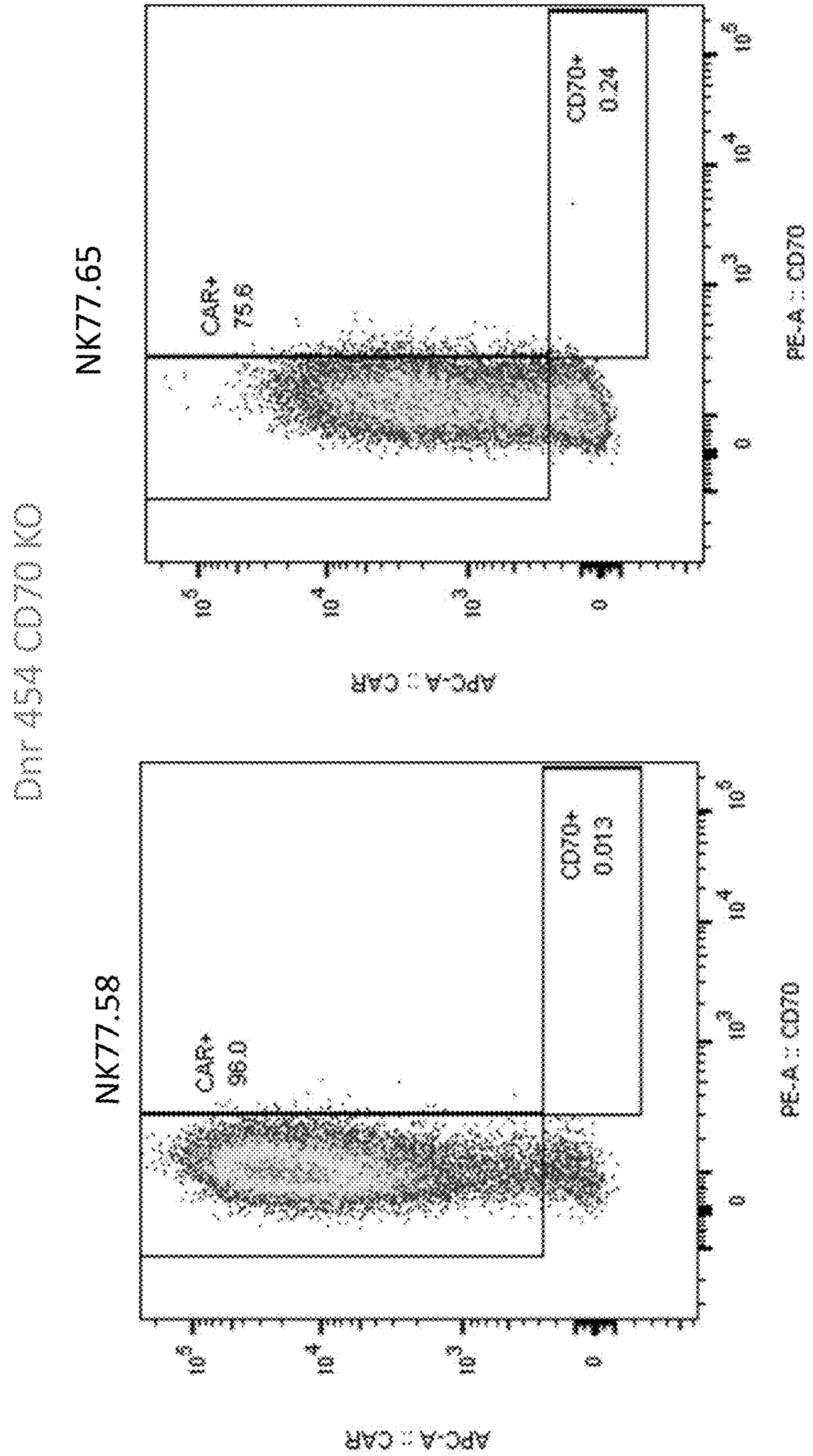
Figure 52A:
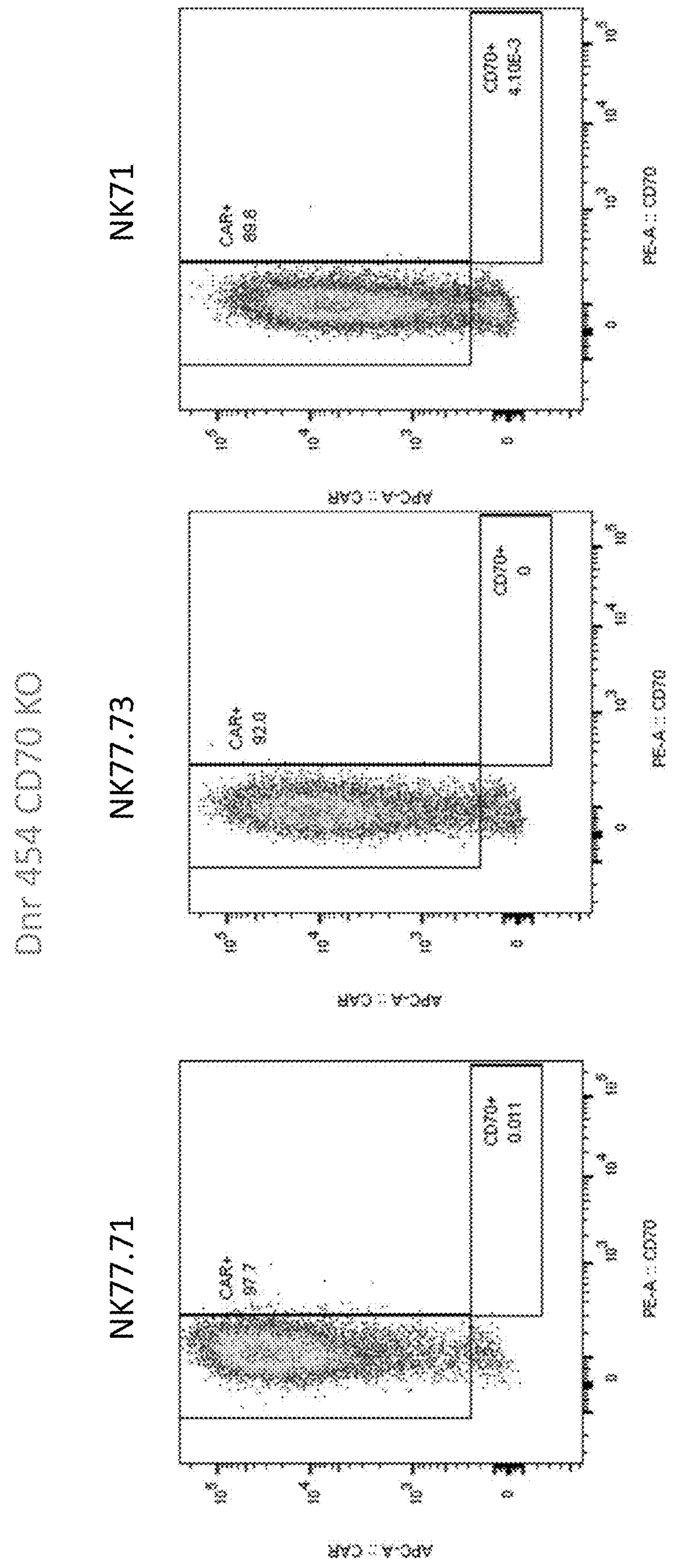
Figures 52B, 52C:
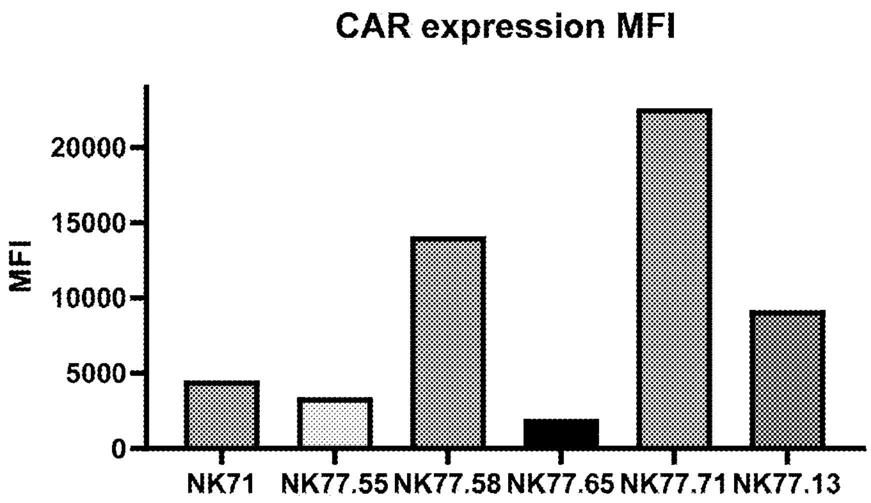
Figure 52D:
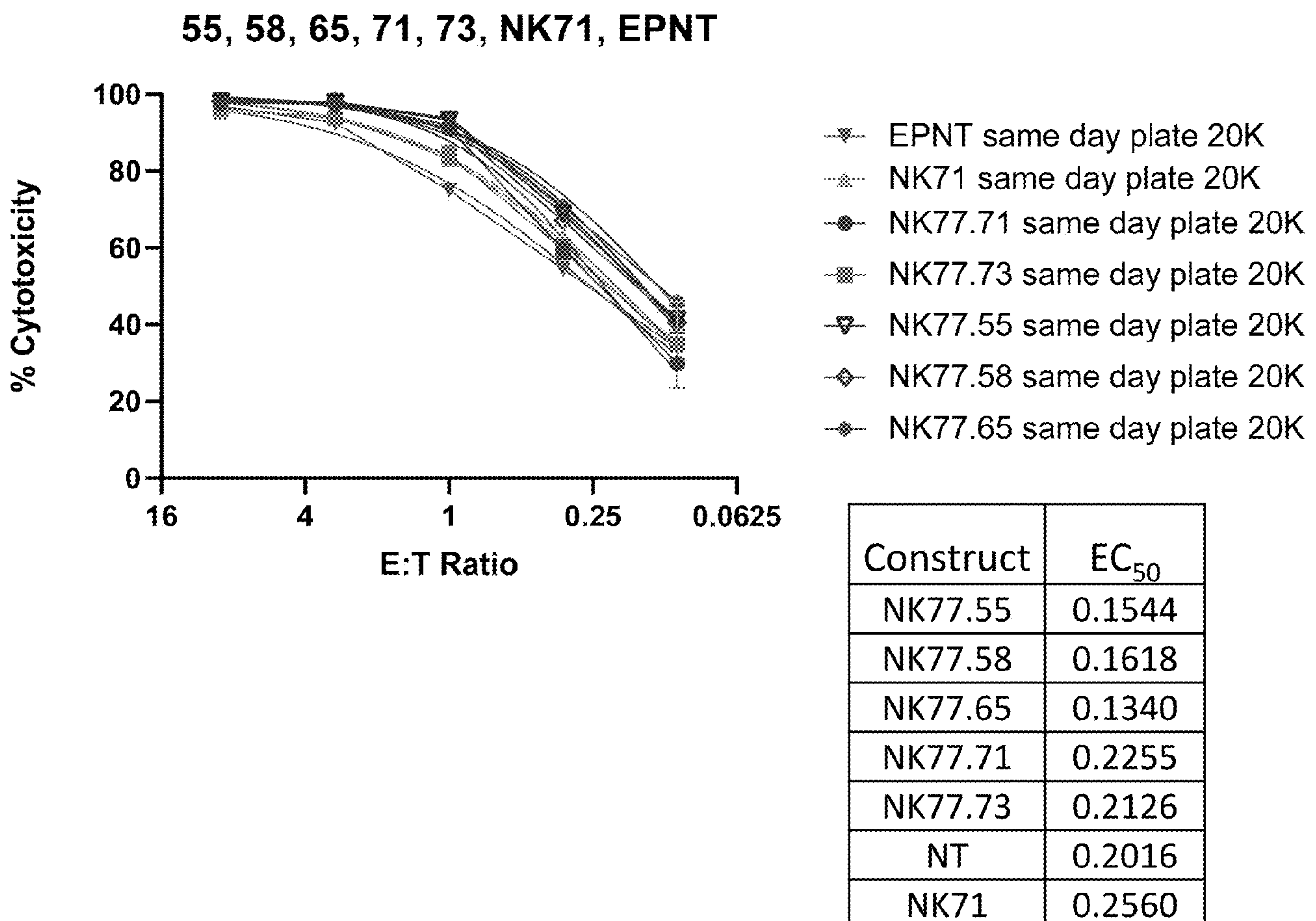

FIGS. 52A-52D shows expression levels of tested anti-CD70 CARs in another donor NK cell population edited to knockout CD70 and preliminary cytotoxicity assays. FIG. 52A shows flow cytometry plots detecting expression of the CAR (by anti-FLAG antibody conjugated with APC) and loss of expression of CD70 (by anti-CD70 antibody conjugated with PE). FIG. 52B shows the quantification of anti-CD70 CAR and CD70 expression in the NK cell populations of FIG. 52A. FIG. 52C show the raw mean fluorescence intensity (MFI) used to quantify CAR expression. FIG. 52D shows a cytotoxicity assay for anti-CD70 CAR NK cell populations against 786-O tumor cells at different effector:target (E:T) ratios and the calculated $EC_{50}$ from the assay.

Figure 53A:
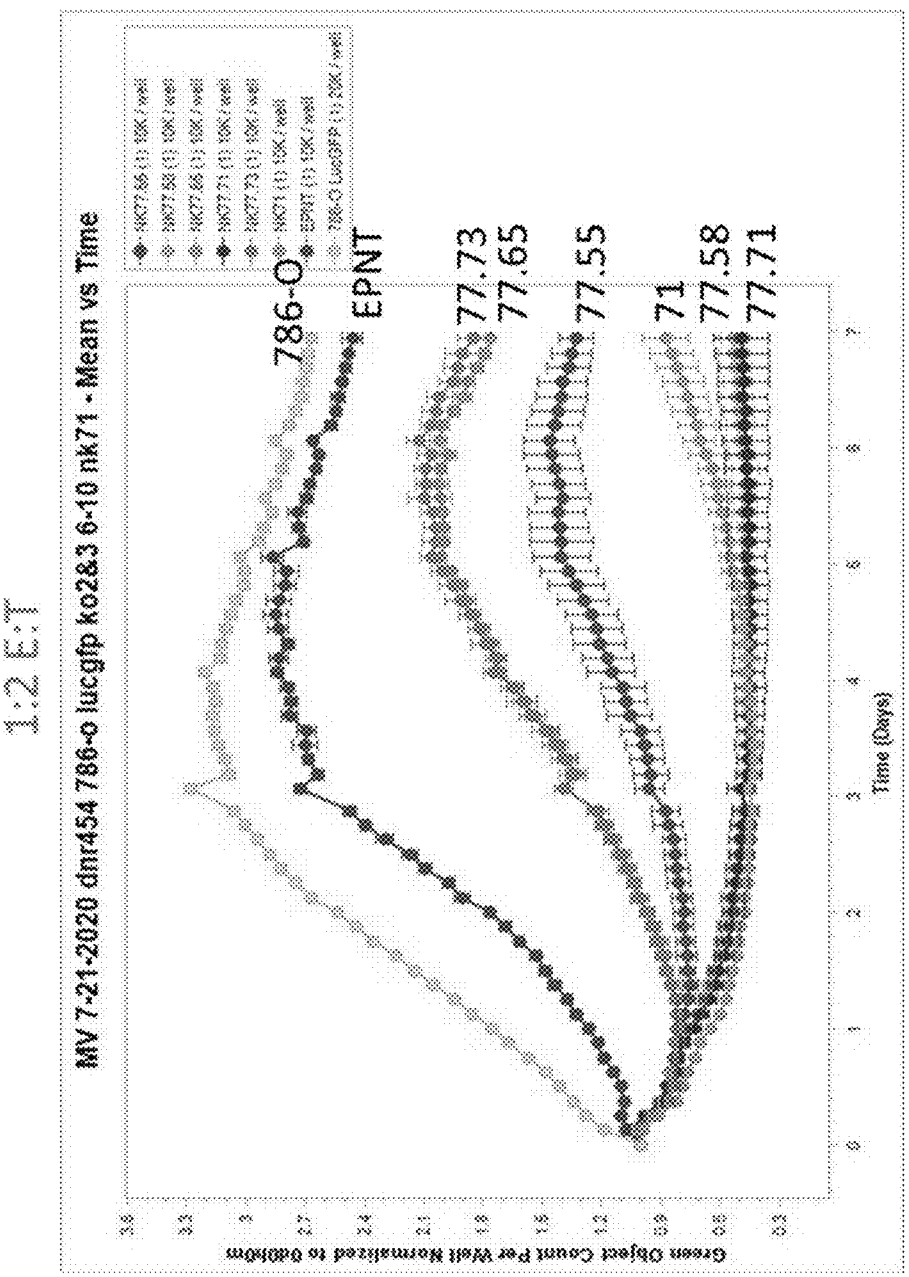
Figure 53B:
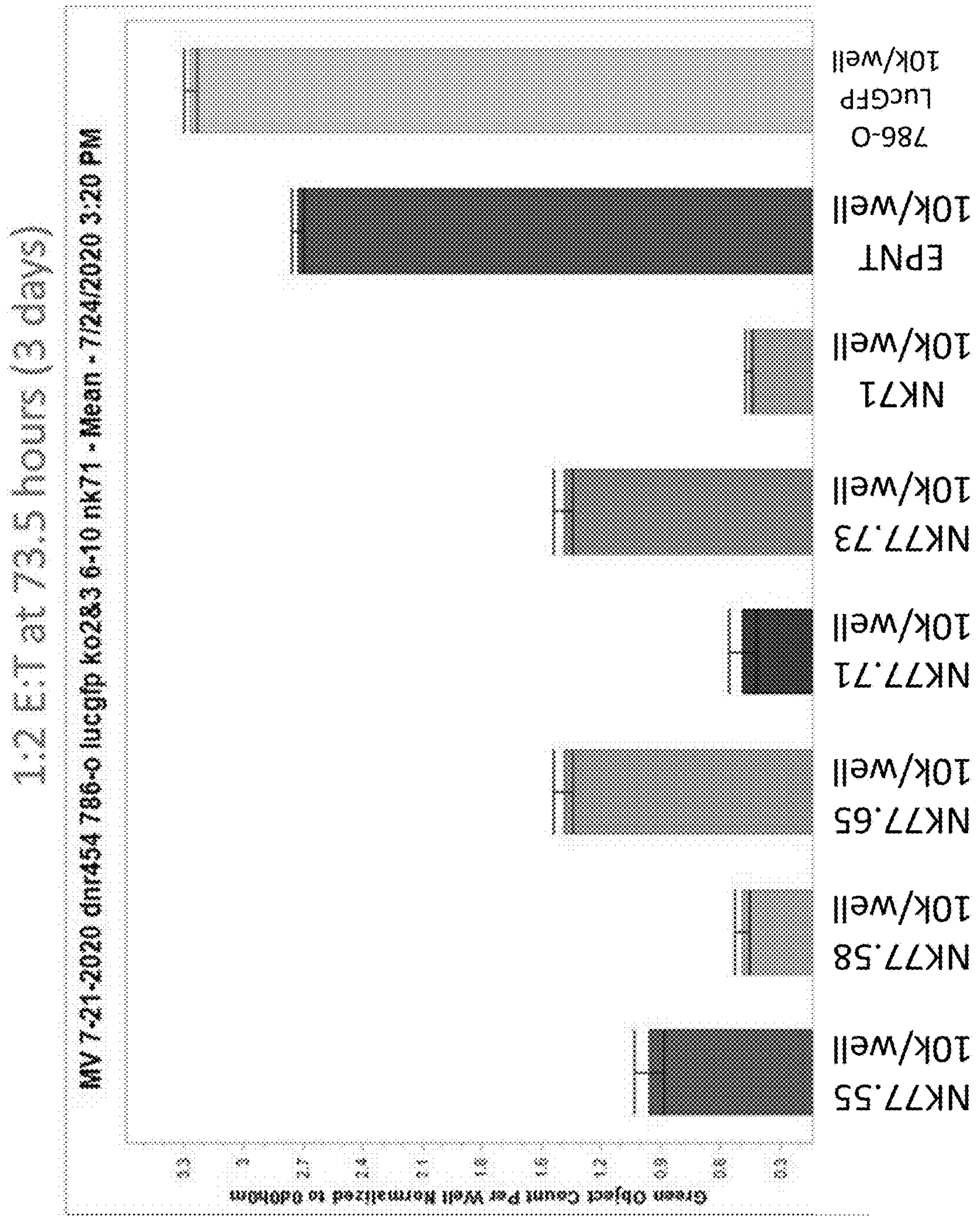
Figure 53C:
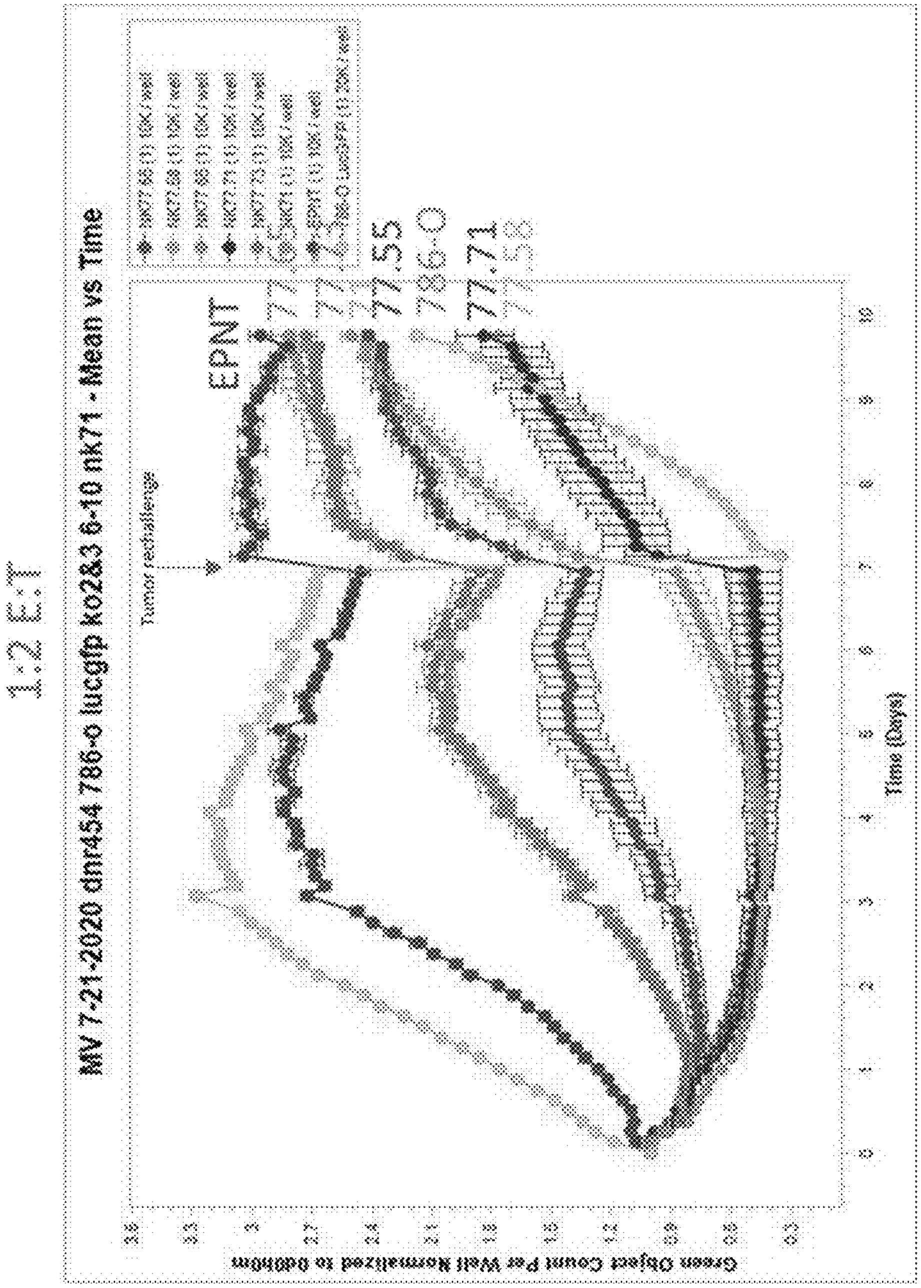
Figure 53D:
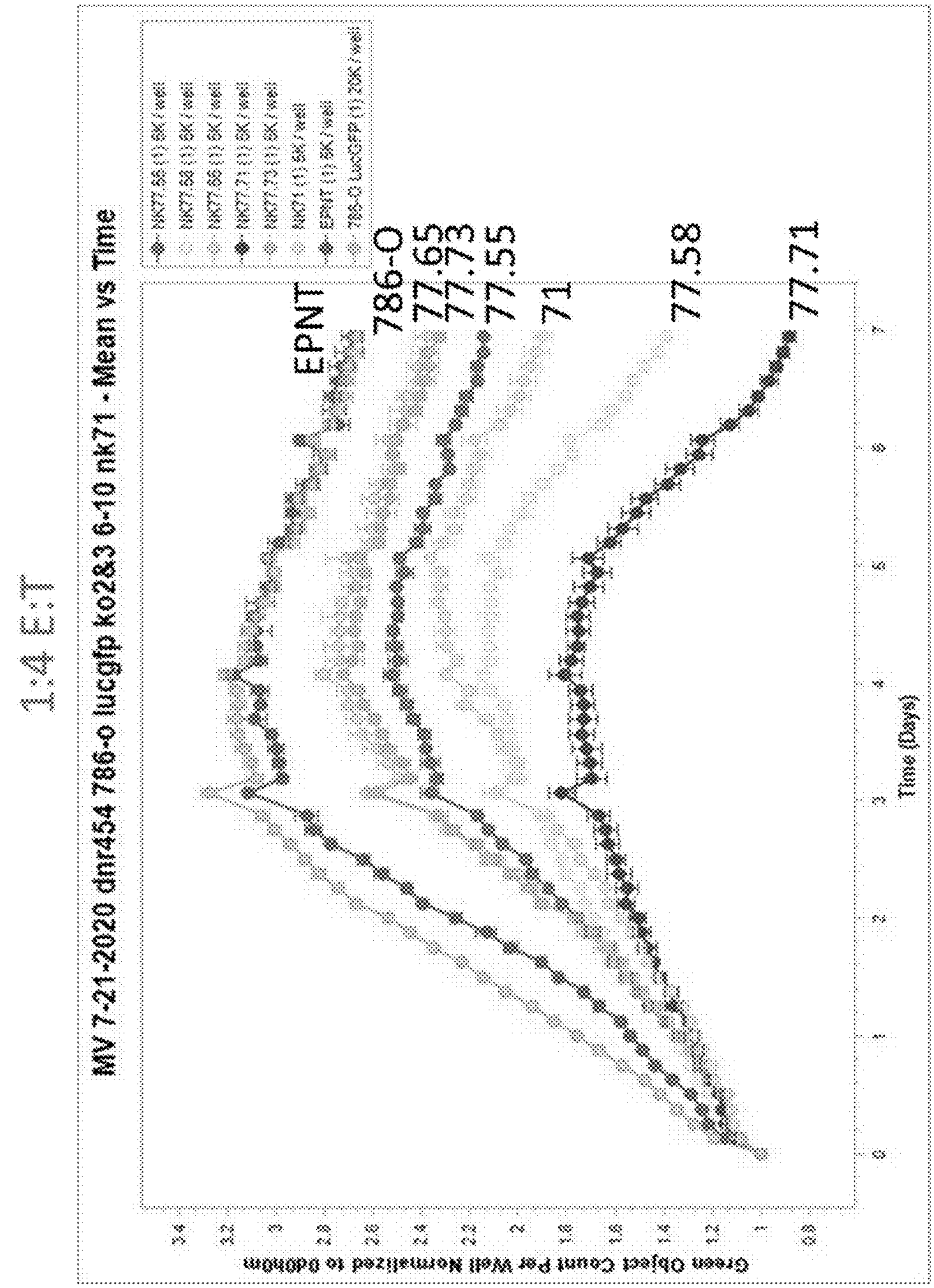
Figure 53E:
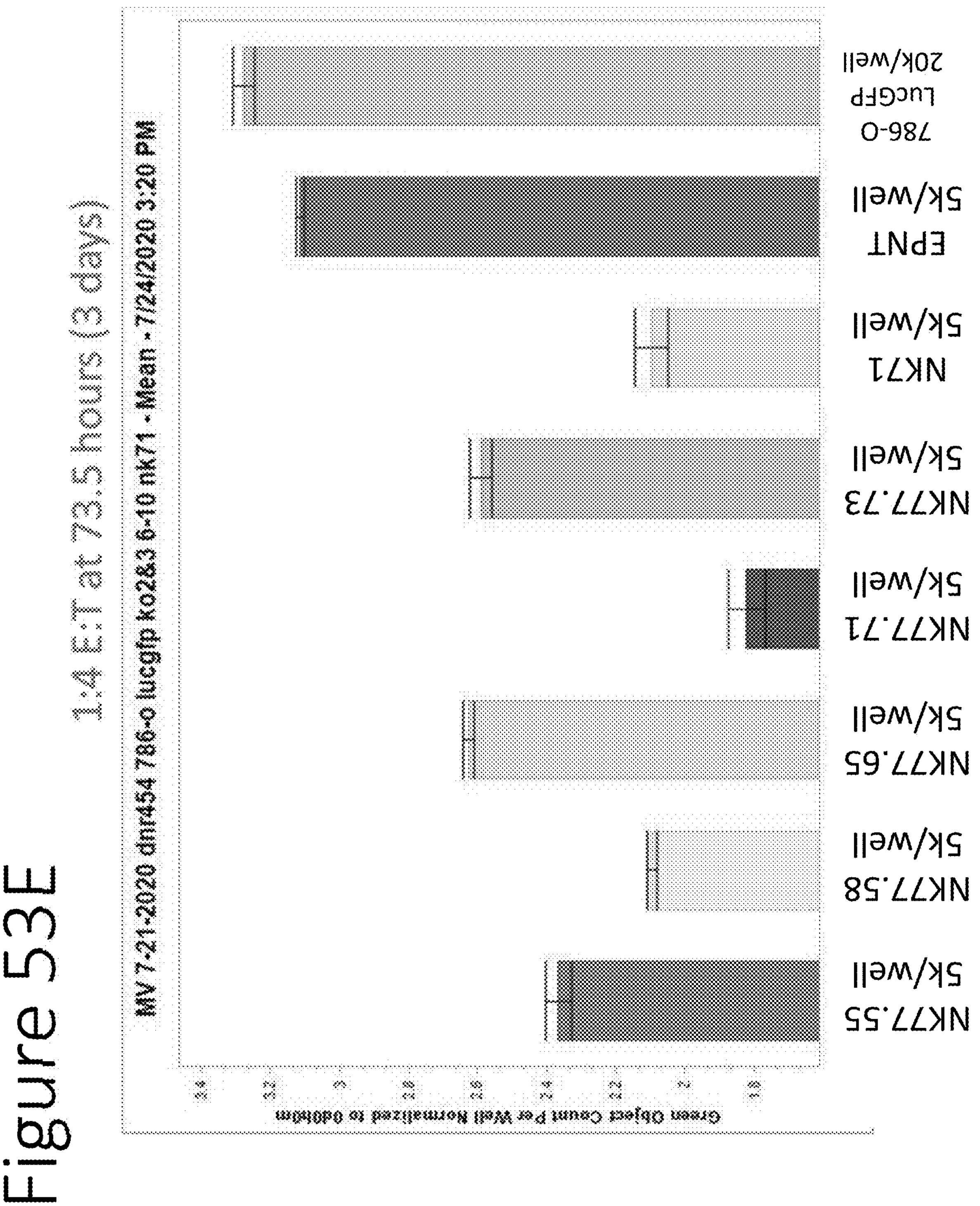
Figure 53F:
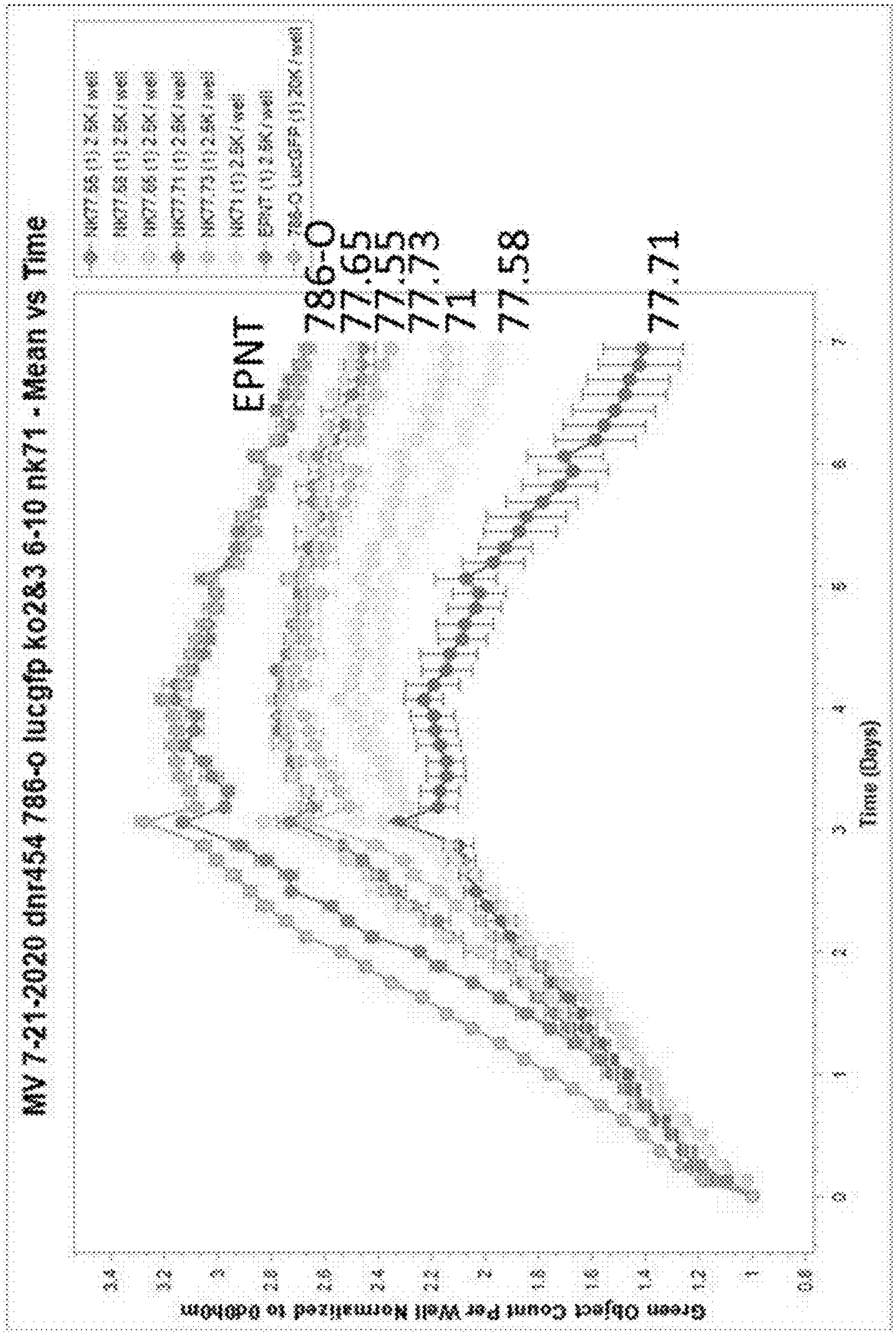

FIGS. 53A-53F shows cytotoxicity data of tested anti-CD70 CARs in CD70 knockout NK cells. FIG. 53A shows cytotoxicity data of tested NK cells against 786-O cells at a 1:2 ratio, for up to 7 days. FIG. 53B shows remaining 786-O cells at 73.5 hours following the NK cell 1:2 co-culture as measured by 786-O GFP fluorescence. FIG. 53C shows cytotoxicity data of the tested NK cells of FIG. 53A, but extended to 10 days. Culture was re-challenged with additional tumor cells at day 7. FIG. 53D shows cytotoxicity data of tested NK cells against 786-O cells at a 1:4 ratio, for up to 7 days. FIG. 53E shows remaining 786-O cells at 73.5 hours following the NK cell 1:4 co-culture as measured by 786-O GFP fluorescence. FIG. 53F shows cytotoxicity data of tested NK cells against 786-O cells at a 1:8 ratio, for up to 7 days.

Figure 54A:
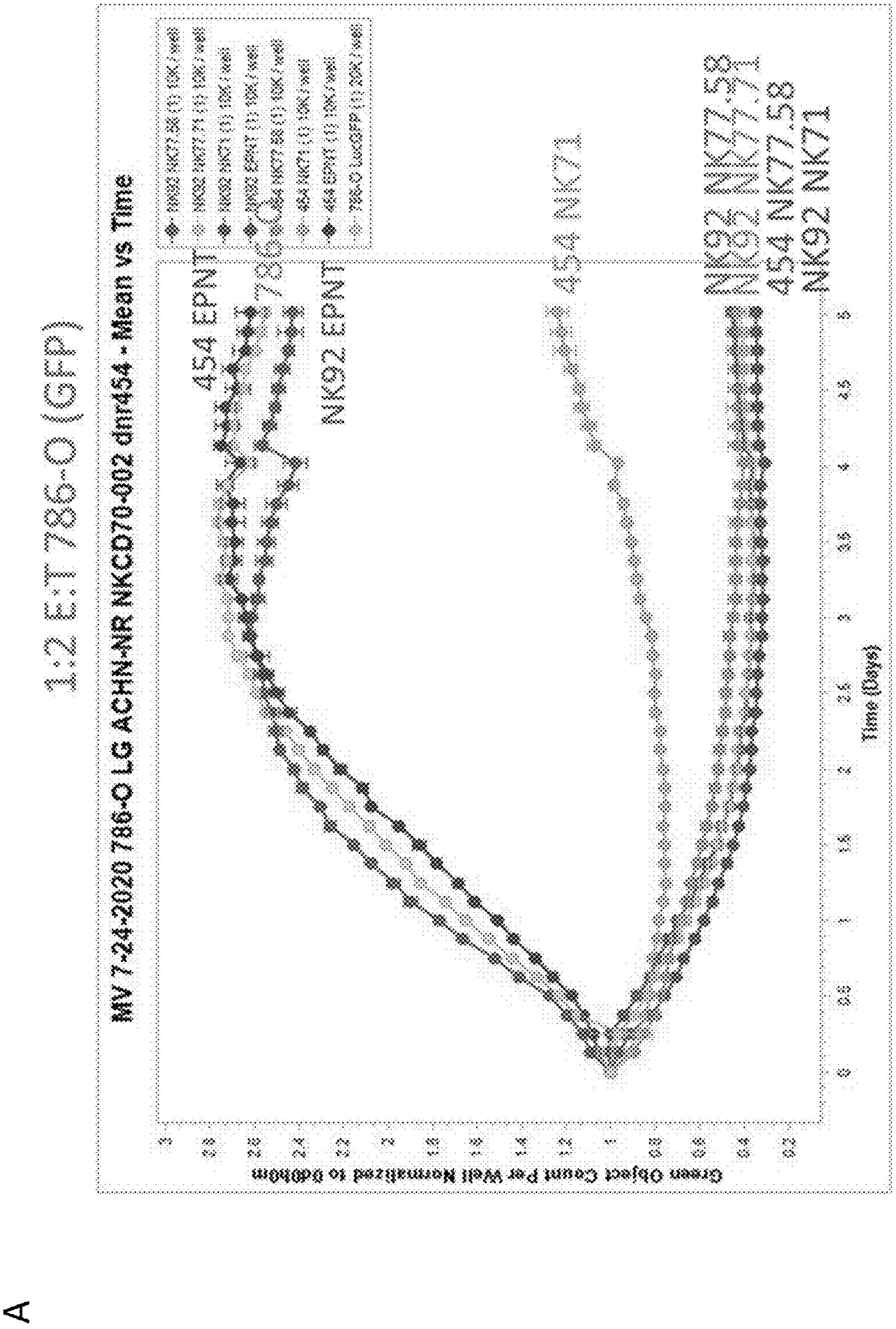
Figure 54B:
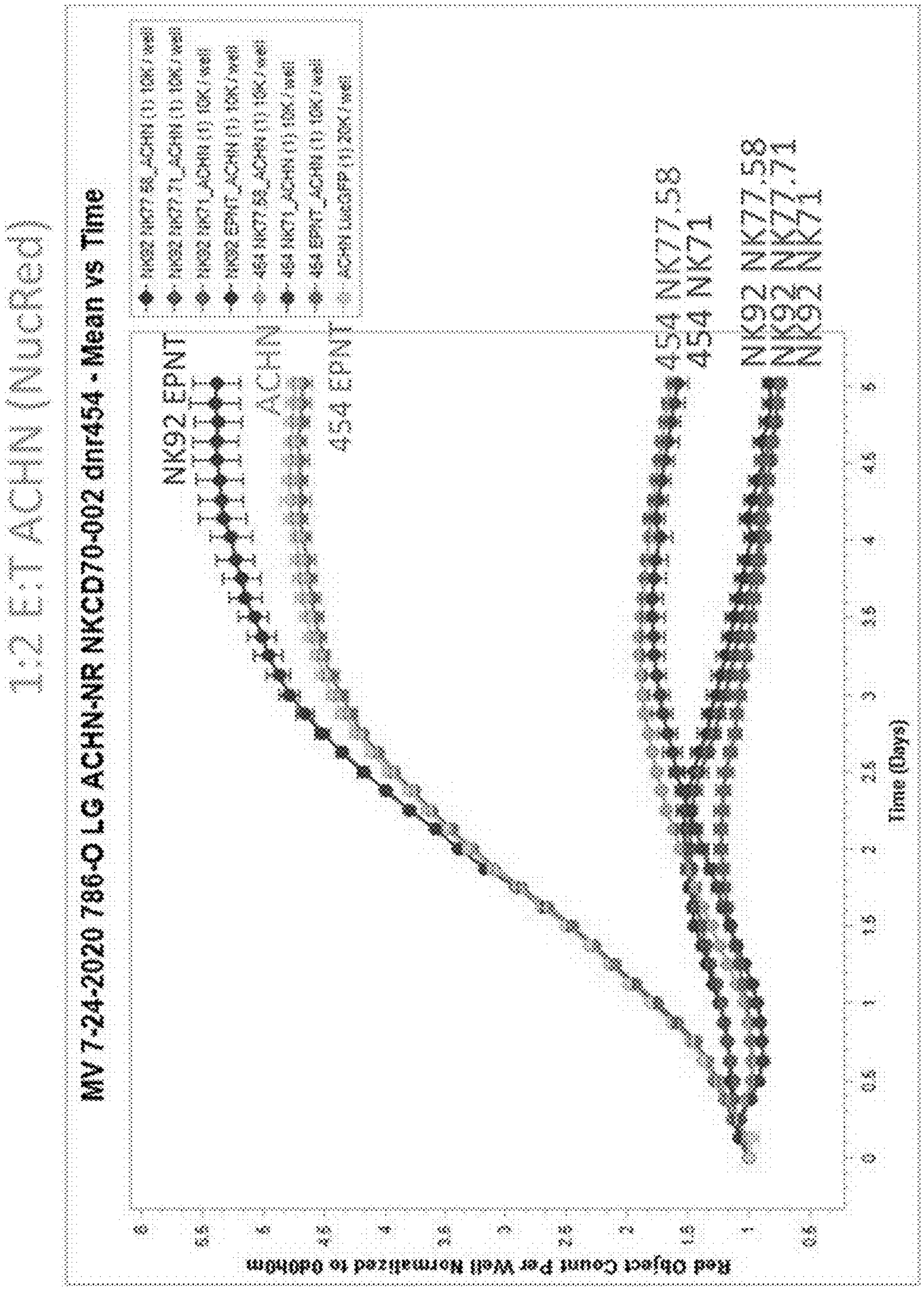
Figure 54C:
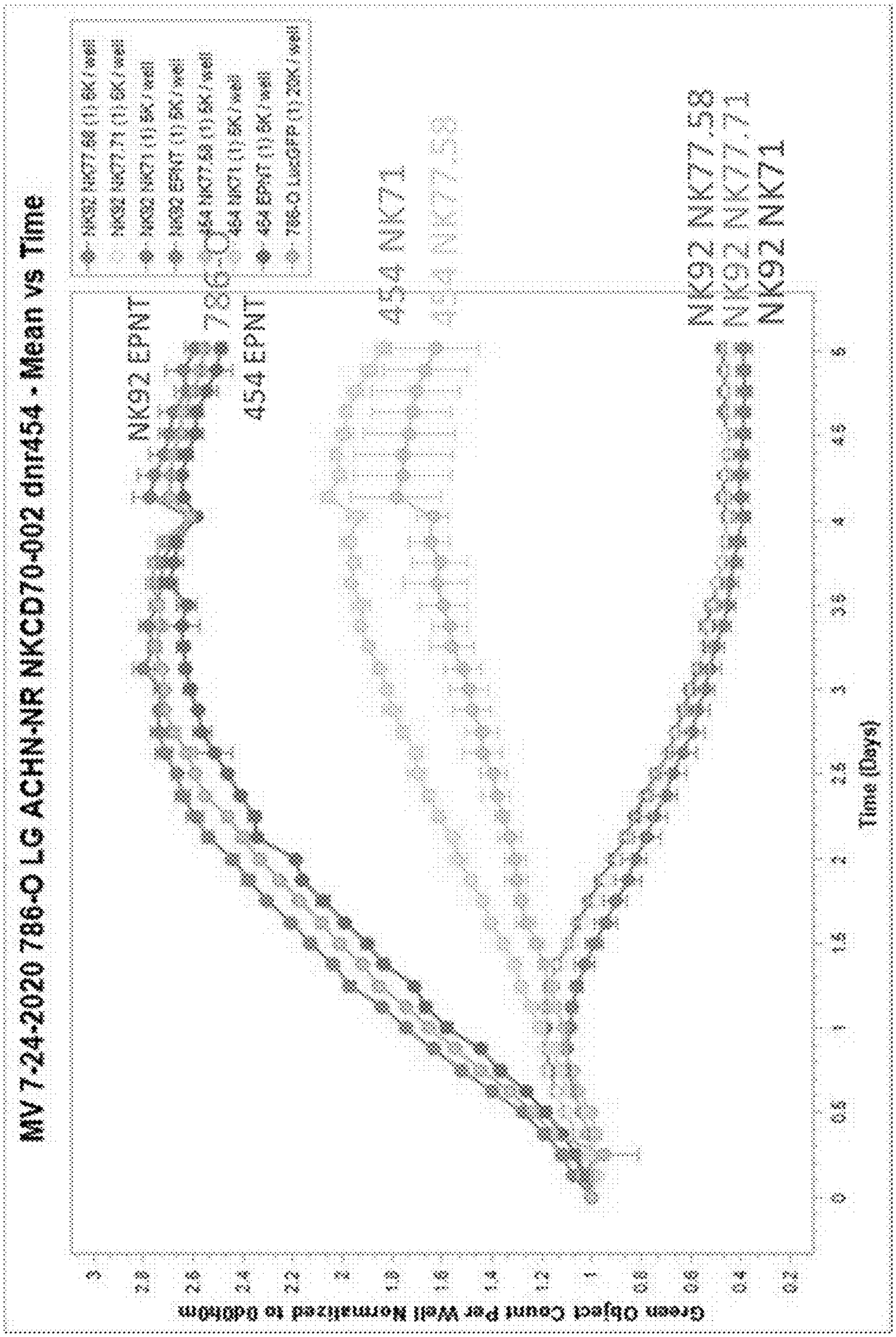
Figure 54D:
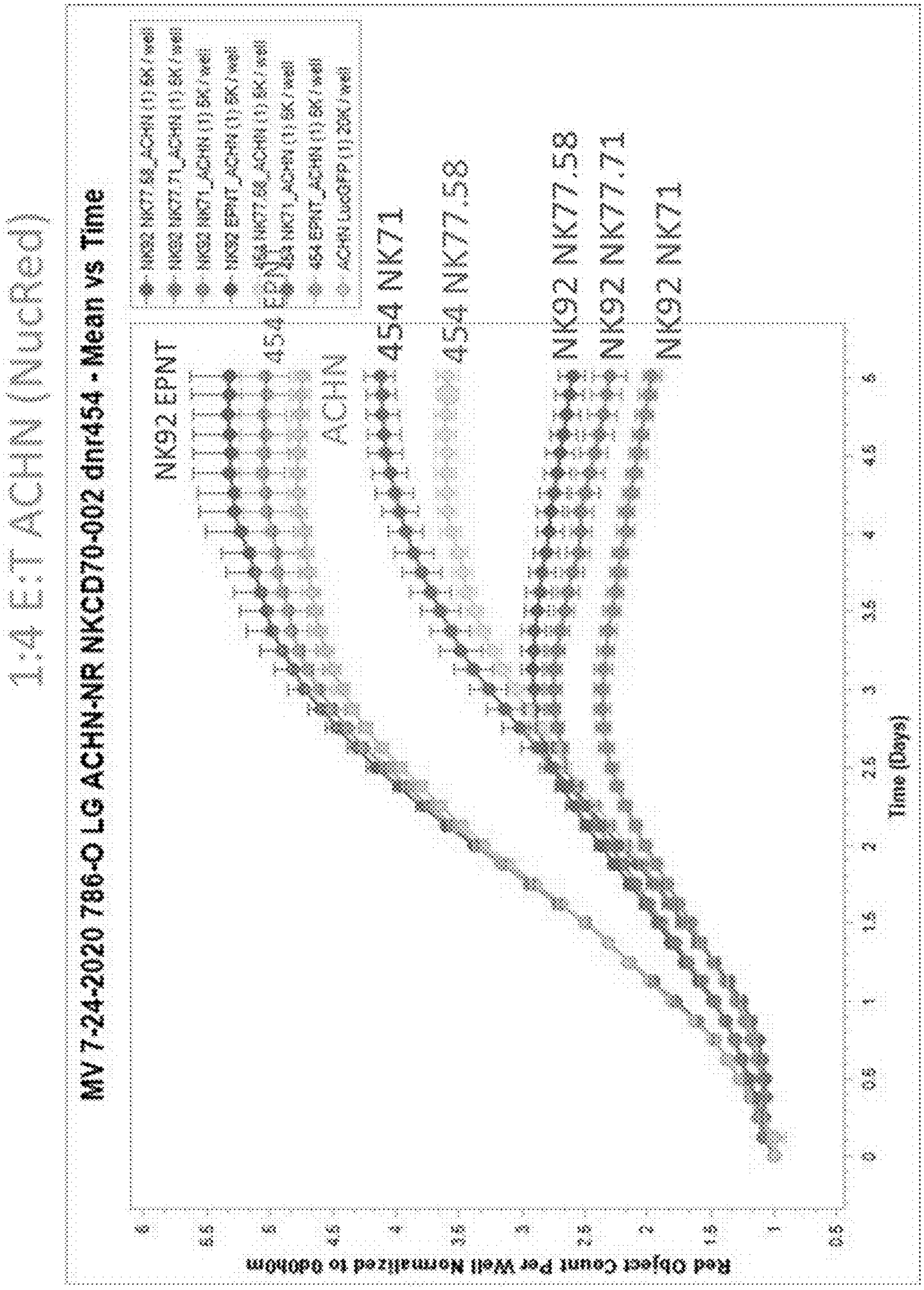

FIG. 54A-54D show cytotoxicity data of tested anti-CD70 CARs in CD70 knockout NK cells against either 786-O cells or ACHN cells. FIG. 54A shows cytotoxicity data for tested NK cells against 786-O cells at a 1:2 ratio, for up to 5 days. The 786-O cells express GFP. FIG. 54B shows cytotoxicity data for tested NK cells against ACHN cells at a 1:2 ratio, for up to 5 days. The ACHN cells are stained with NucRed. FIG. 54C shows cytotoxicity data for tested NK cells against 786-O cells at a 1:4 ratio, for up to 5 days. FIG. 54D shows cytotoxicity data for tested NK cells against ACHN cells at a 1:4 ratio, for up to 5 days.

Figure 55A:
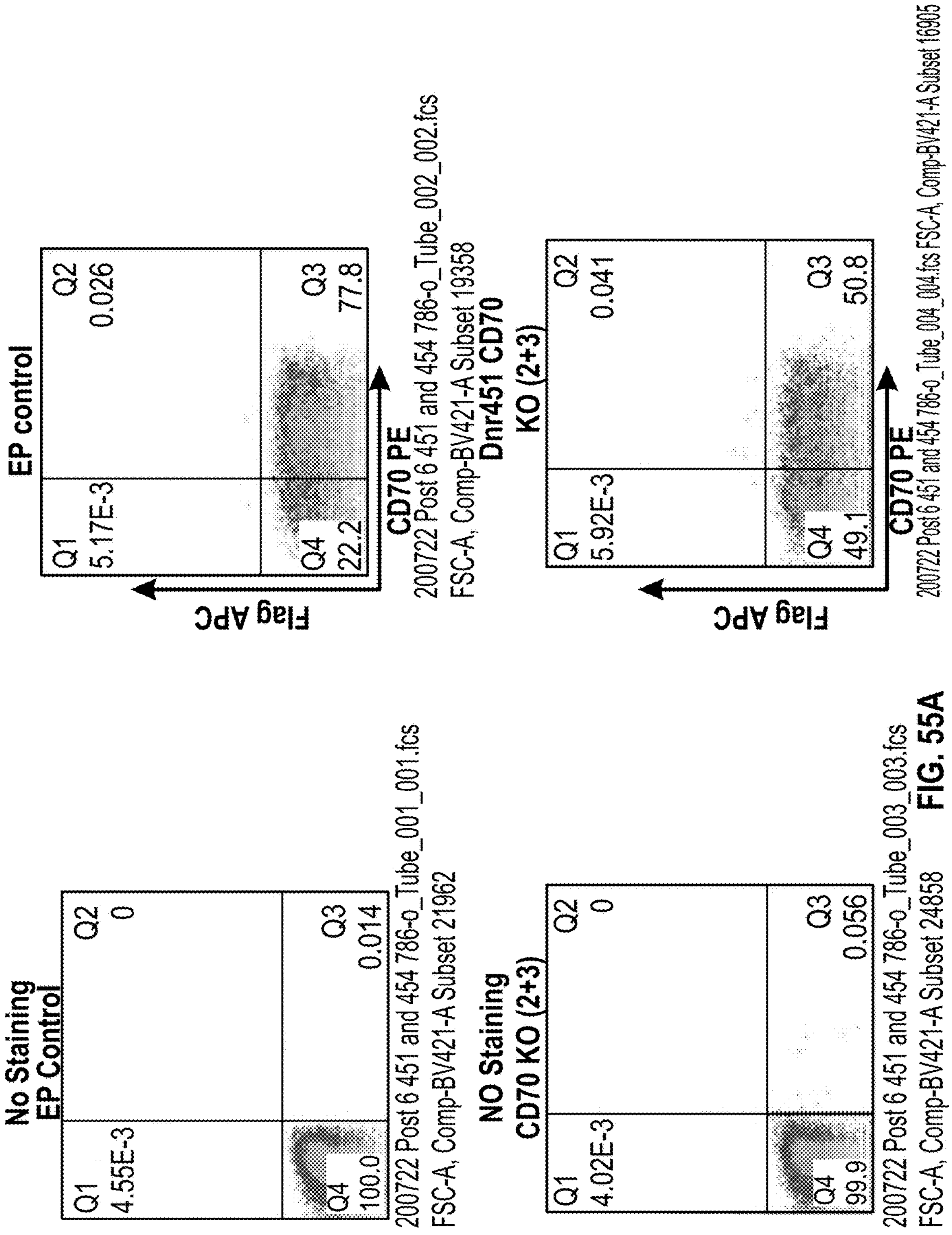
Figure 55A:
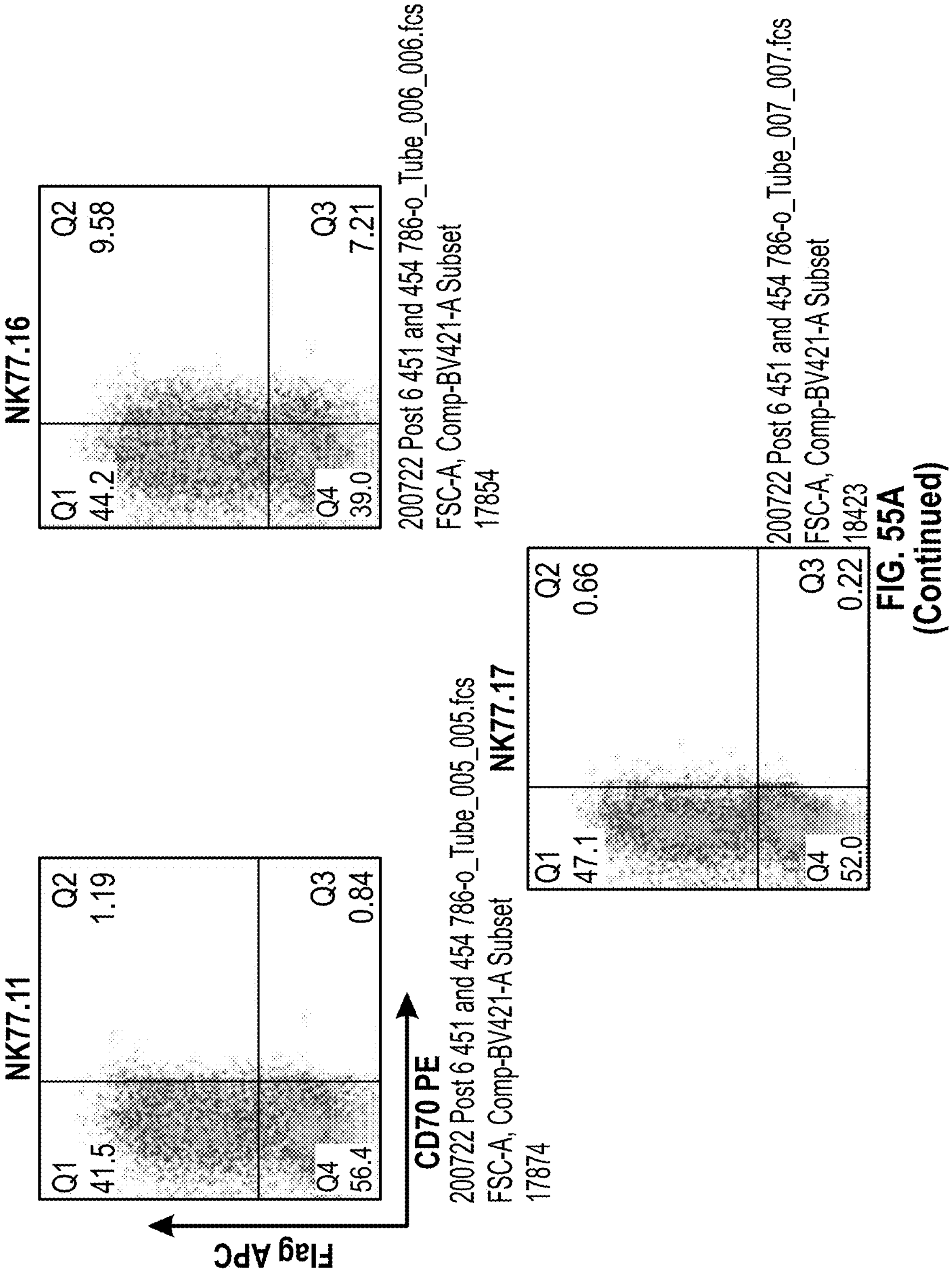
Figures 55B, 55C:
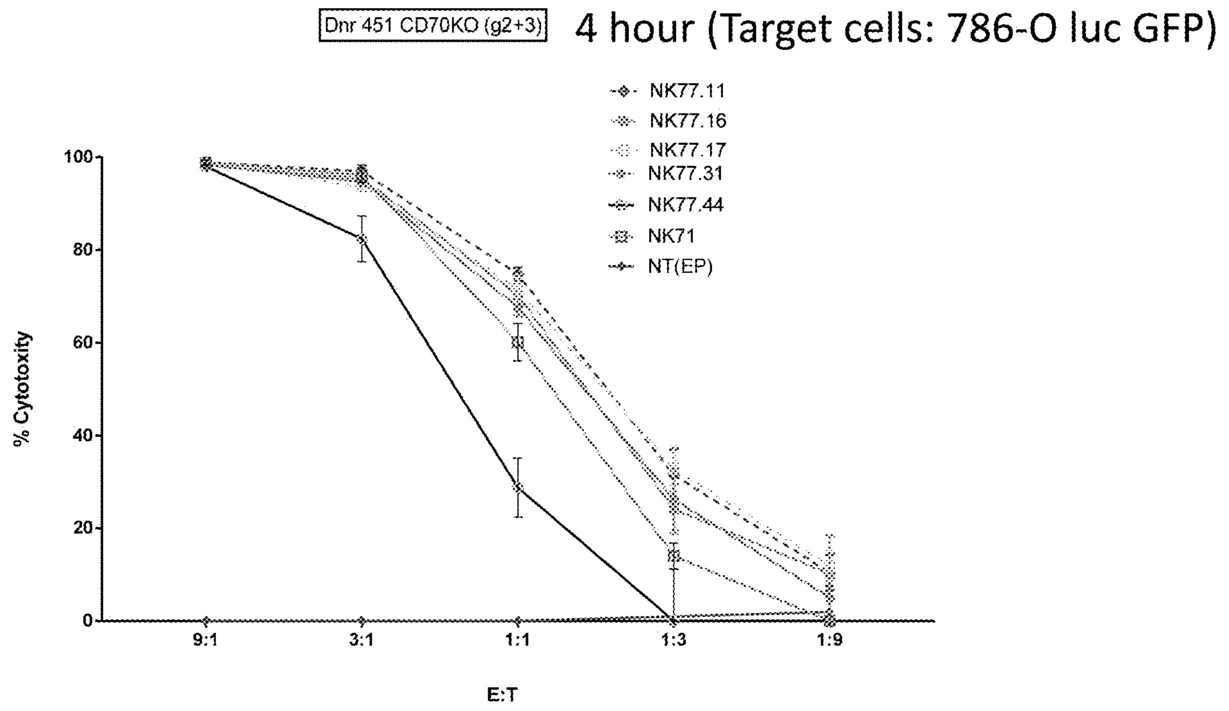
Figure 55D:
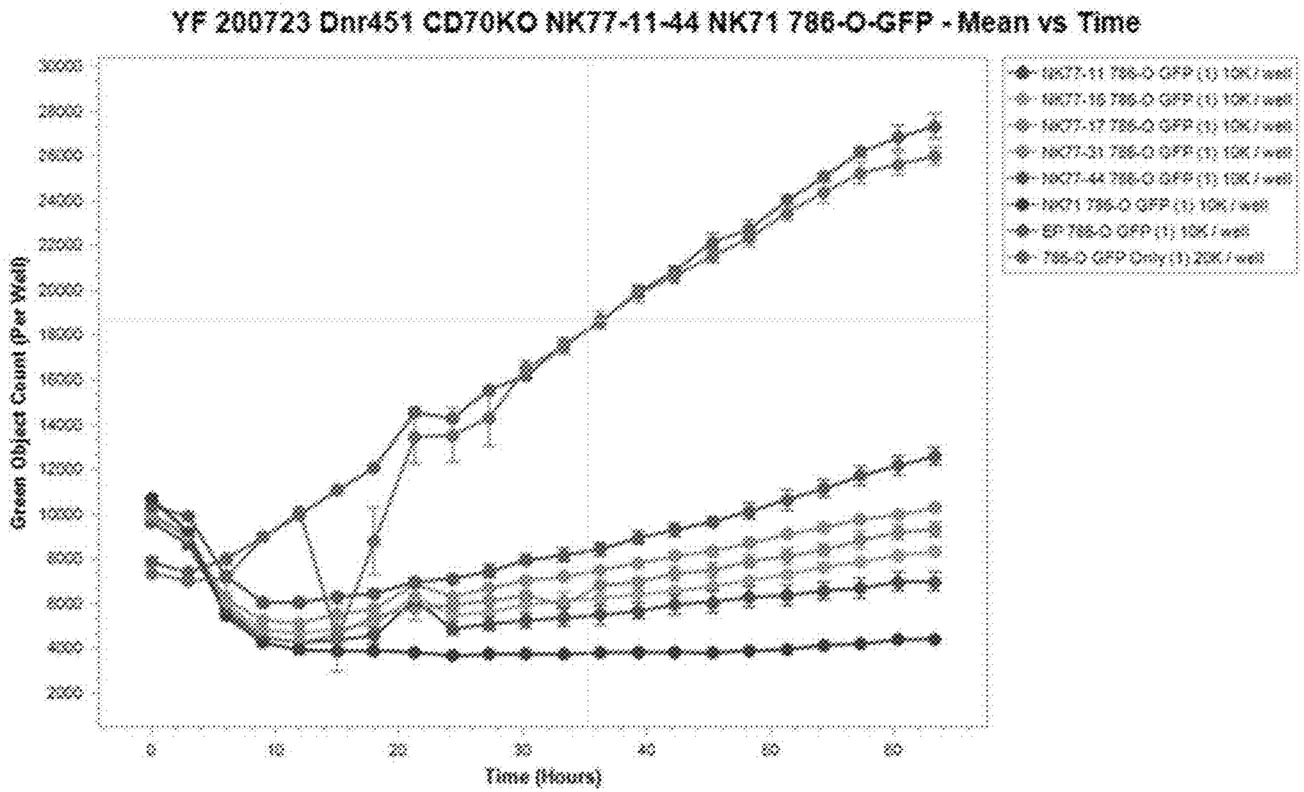
Figure 55E:
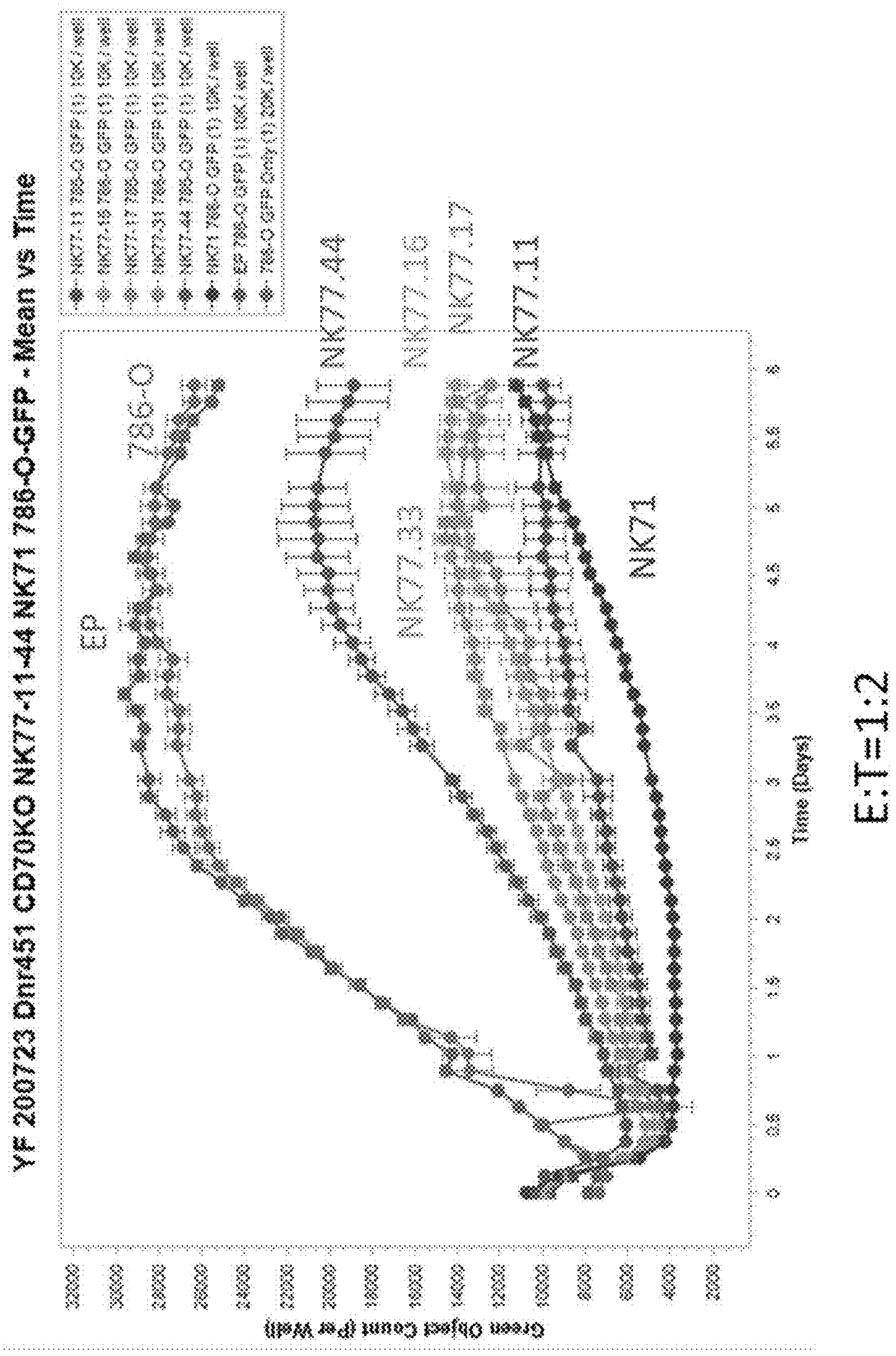
Figure 55F:
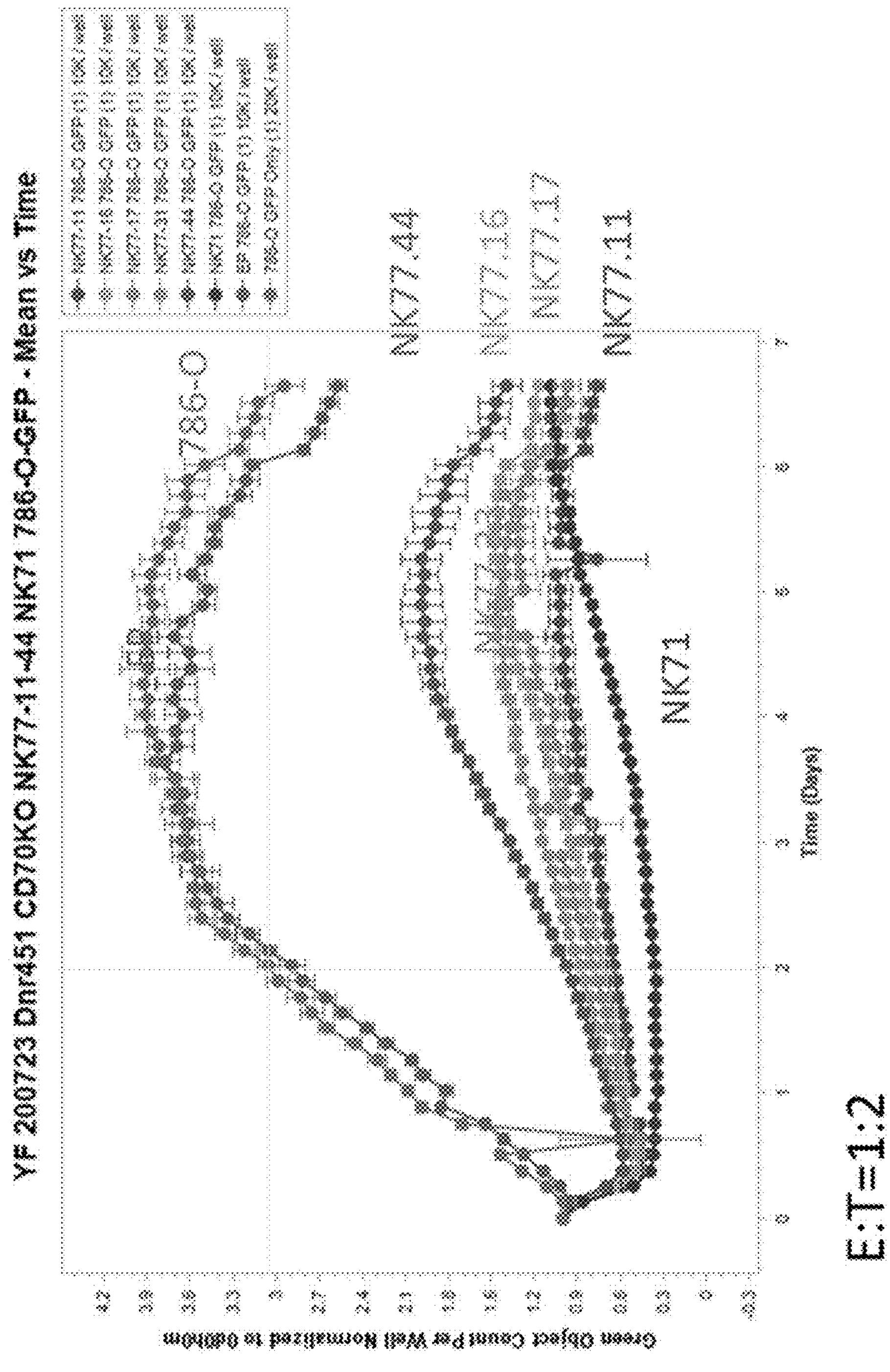
Figure 55G:
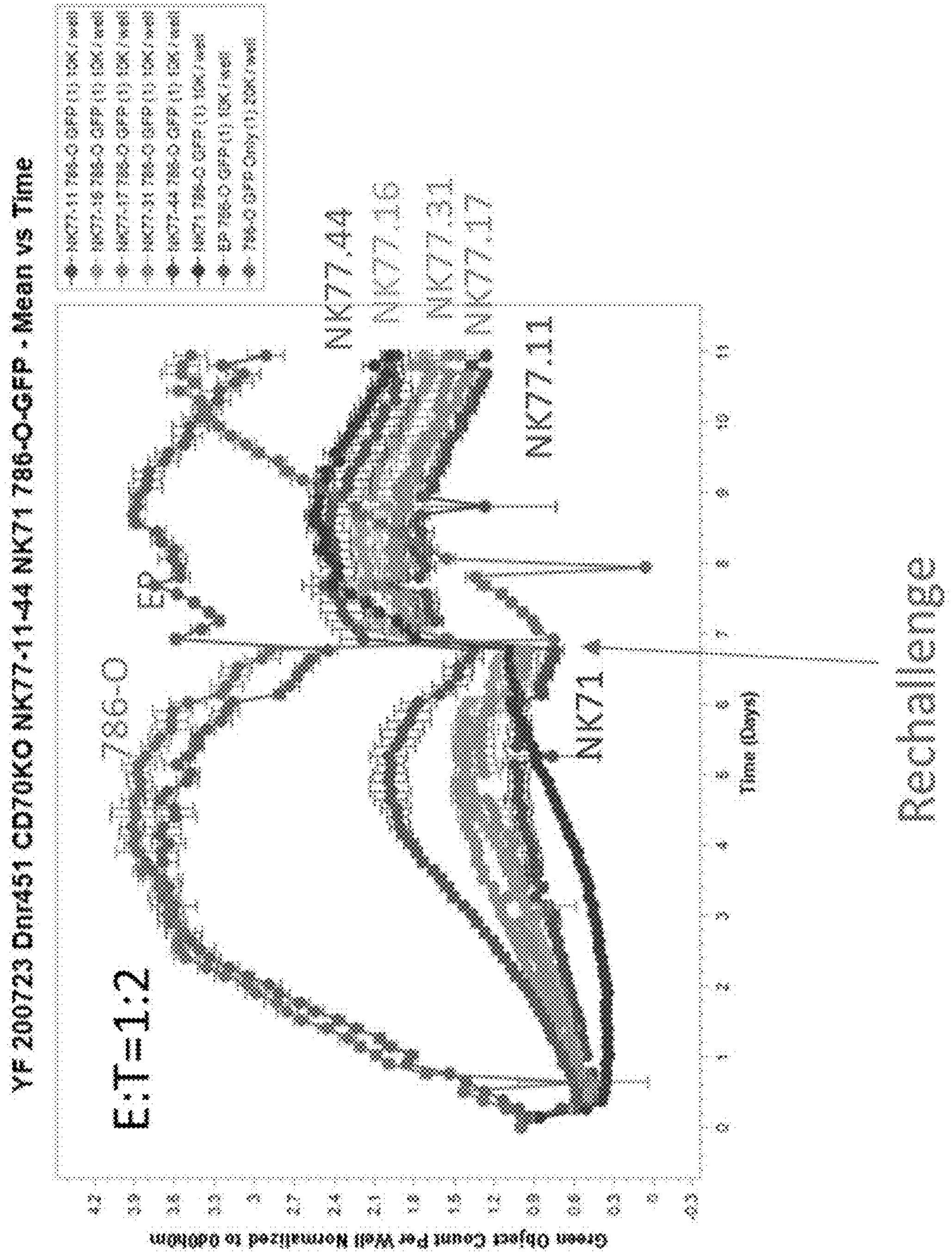
Figure 55H:
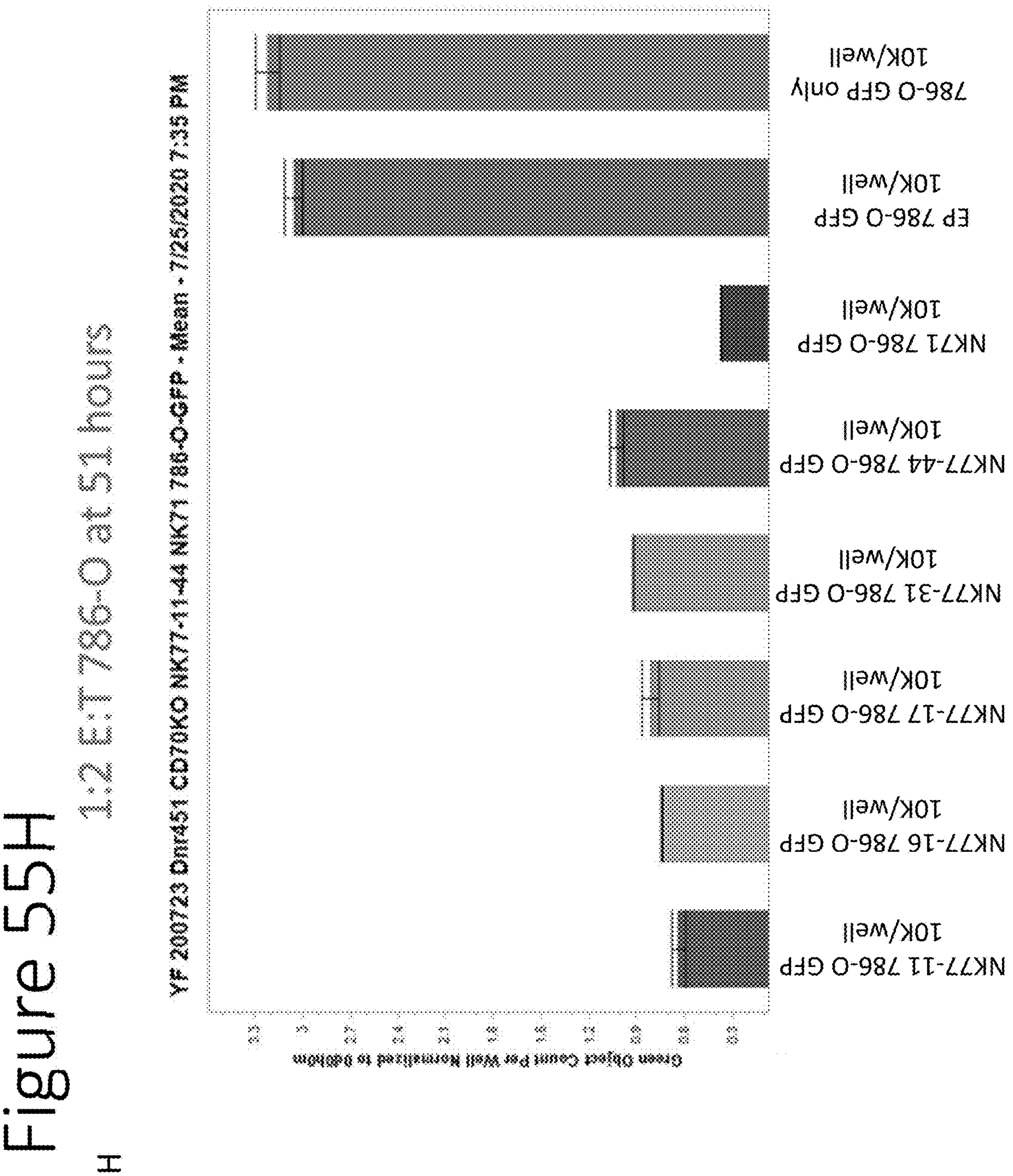

FIGS. 55A-55M show cytotoxicity data of tested anti-CD70 CARs in CD70 knockout NK cells from one donor. FIG. 55A shows flow cytometry plots detecting expression of the CAR (by APC anti-FLAG) and loss of expression of CD70 (by PE anti-CD70). FIG. 55B show preliminary cytotoxicity data for tested NK cells against 786-O cells at different E:T ratios at 4 hours of co-culture. FIG. 55C shows quantification of the expressed anti-CD70 CAR, loss of CD70 expression, and the calculated $EC_{50}$ from the assay of FIG. 55B. FIG. 55D shows cytotoxicity data of tested NK cells against 786-O cells at a 1:2 ratio, for up to 64 hours. FIG. 55E shows cytotoxicity data of tested NK cells against 786-O cells at a 1:2 ratio, for up to 6 days. FIG. 55F shows cytotoxicity data of tested NK cells against 786-O cells at a 1:2 ratio, for up to 7 days. FIG. 55G shows cytotoxicity data of tested NK cells as seen in FIG. 55F but extended to 11 days and re-challenged with additional tumor cells at day 7. FIG. 55H shows remaining 786-O cells at 51 hours following the NK cell 1:2 co-culture as measured by 786-O GFP fluorescence.

Figure 55I:
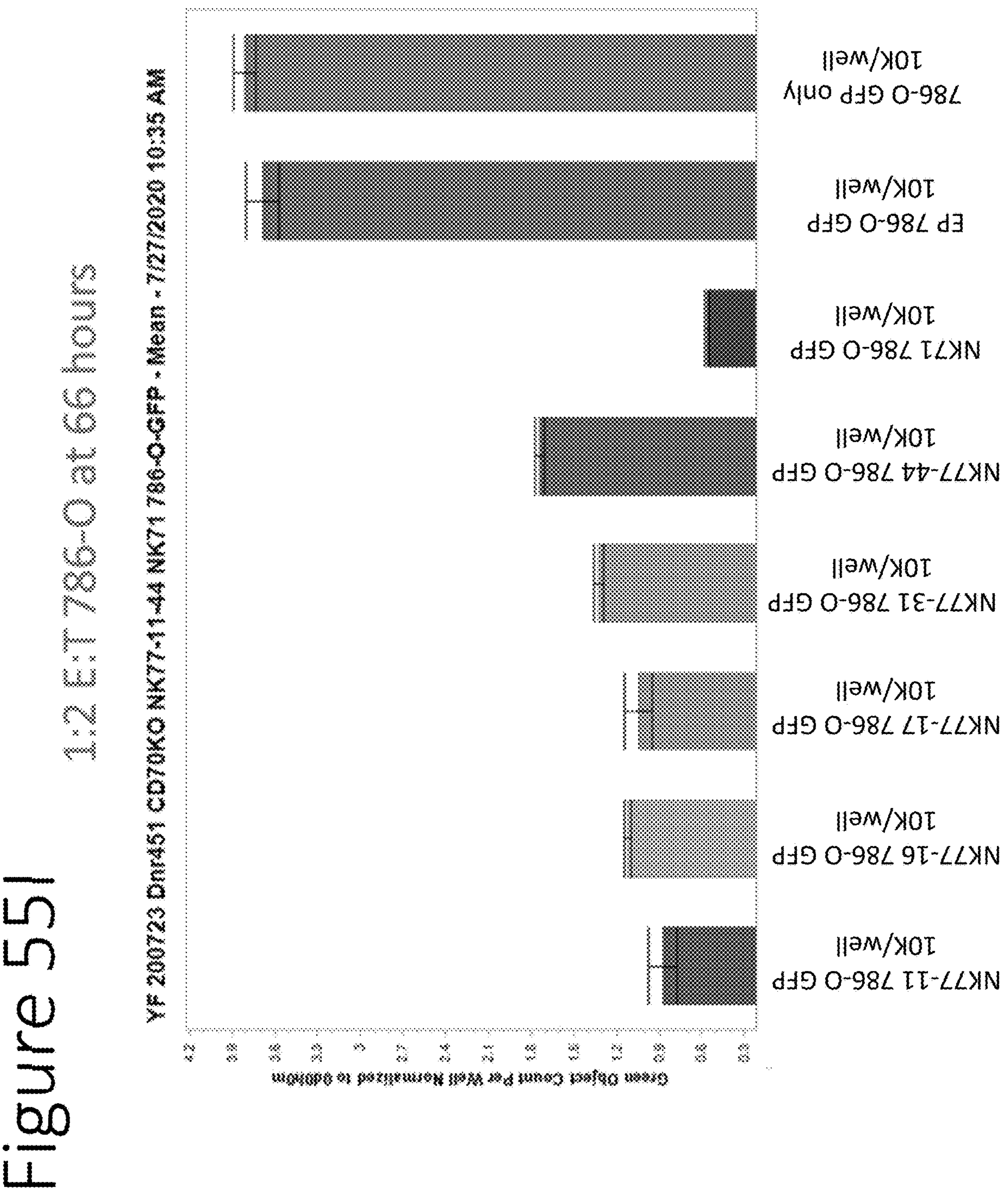
Figure 55J:
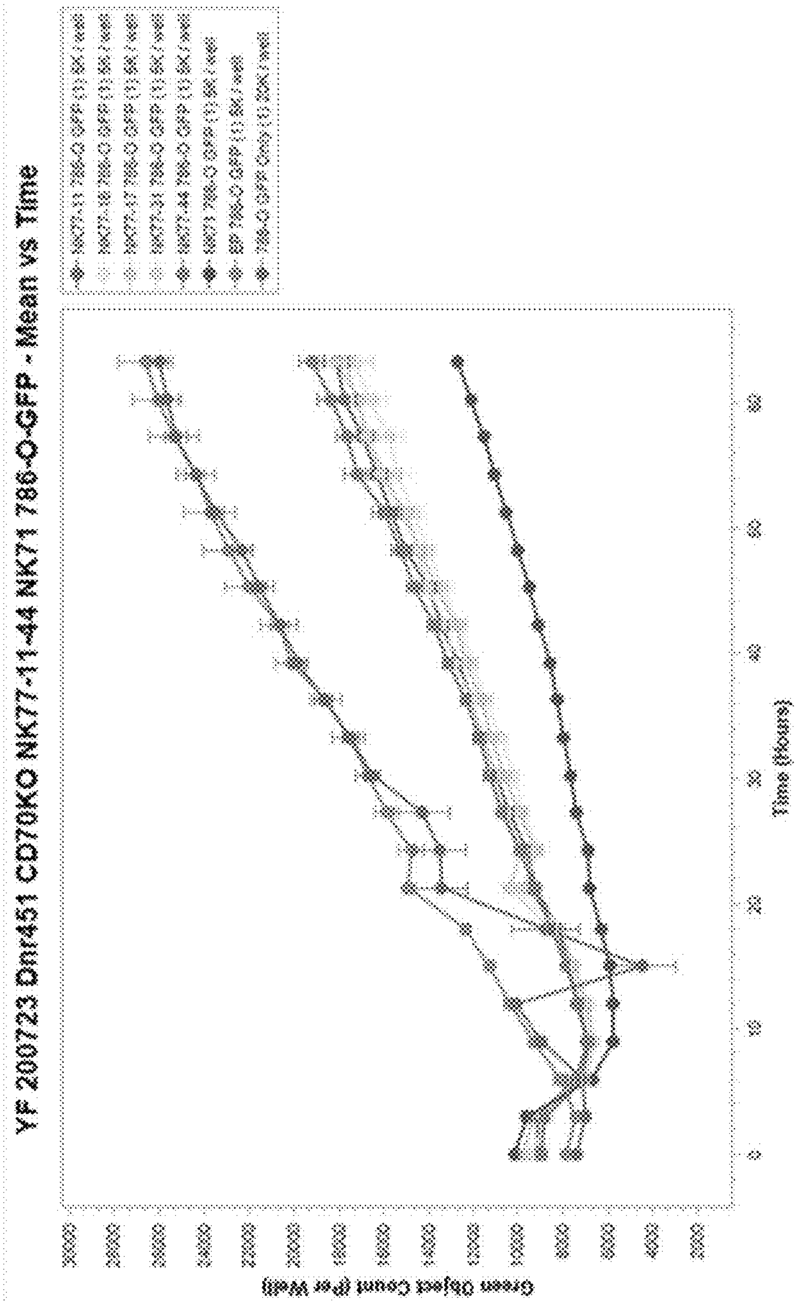
Figure 55K:
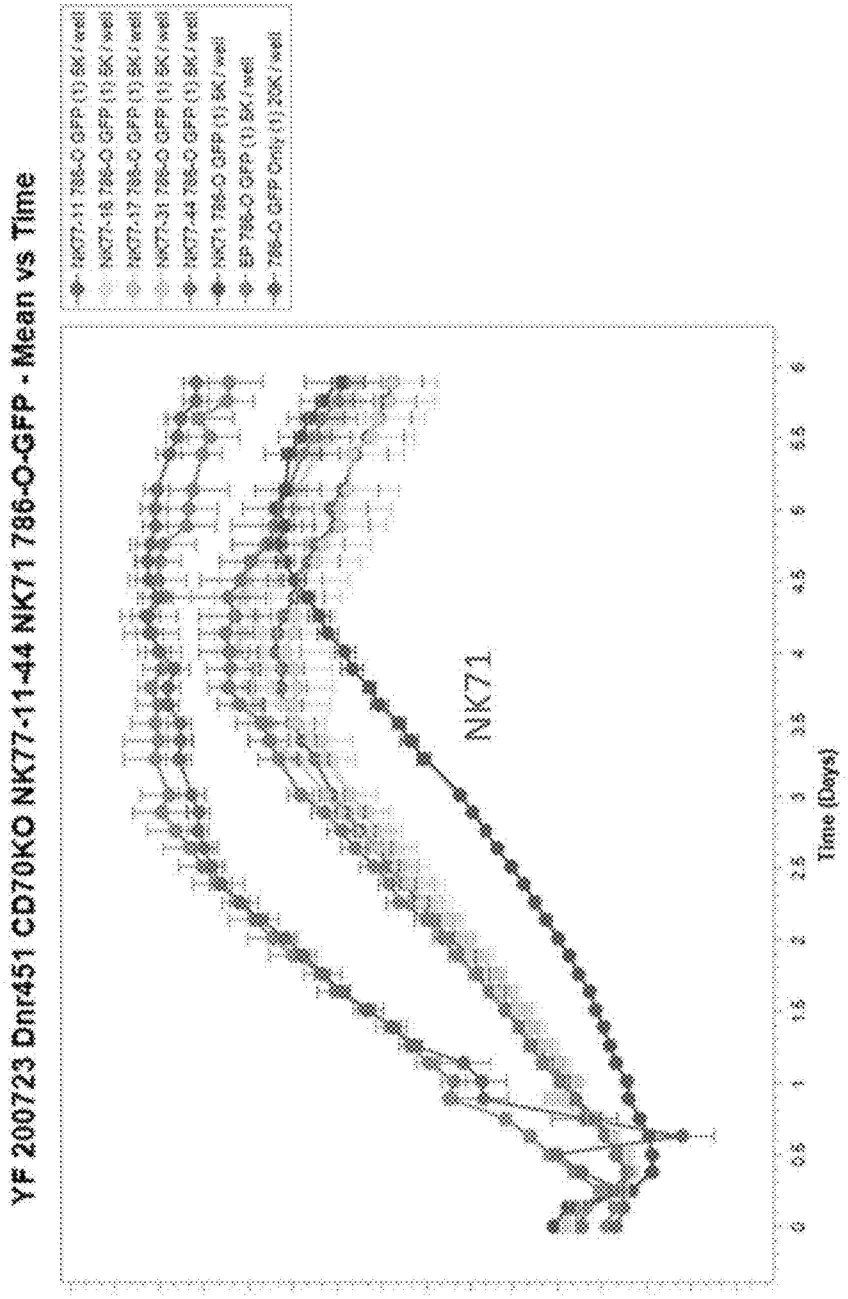
Figure 55L:
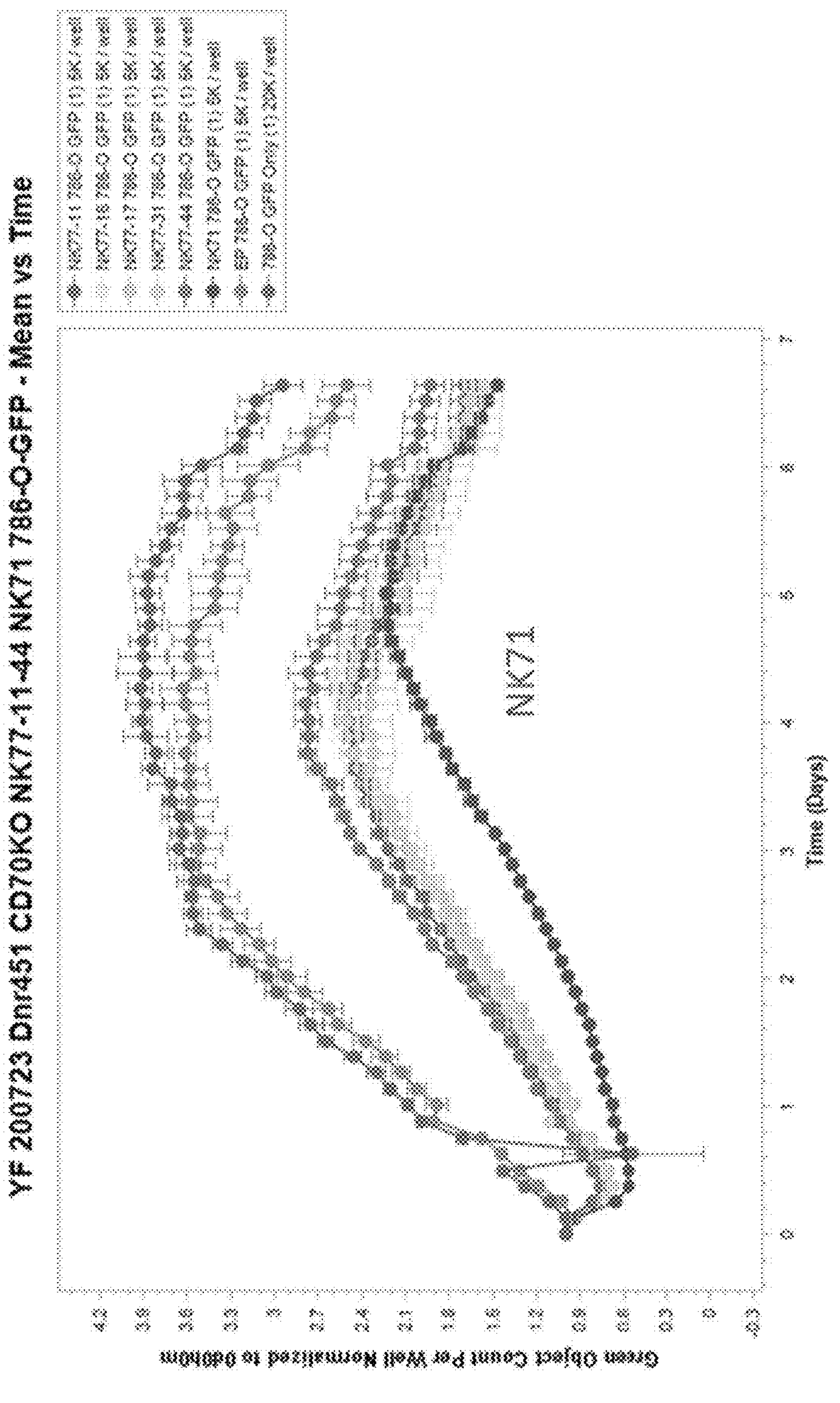
Figure 55M:
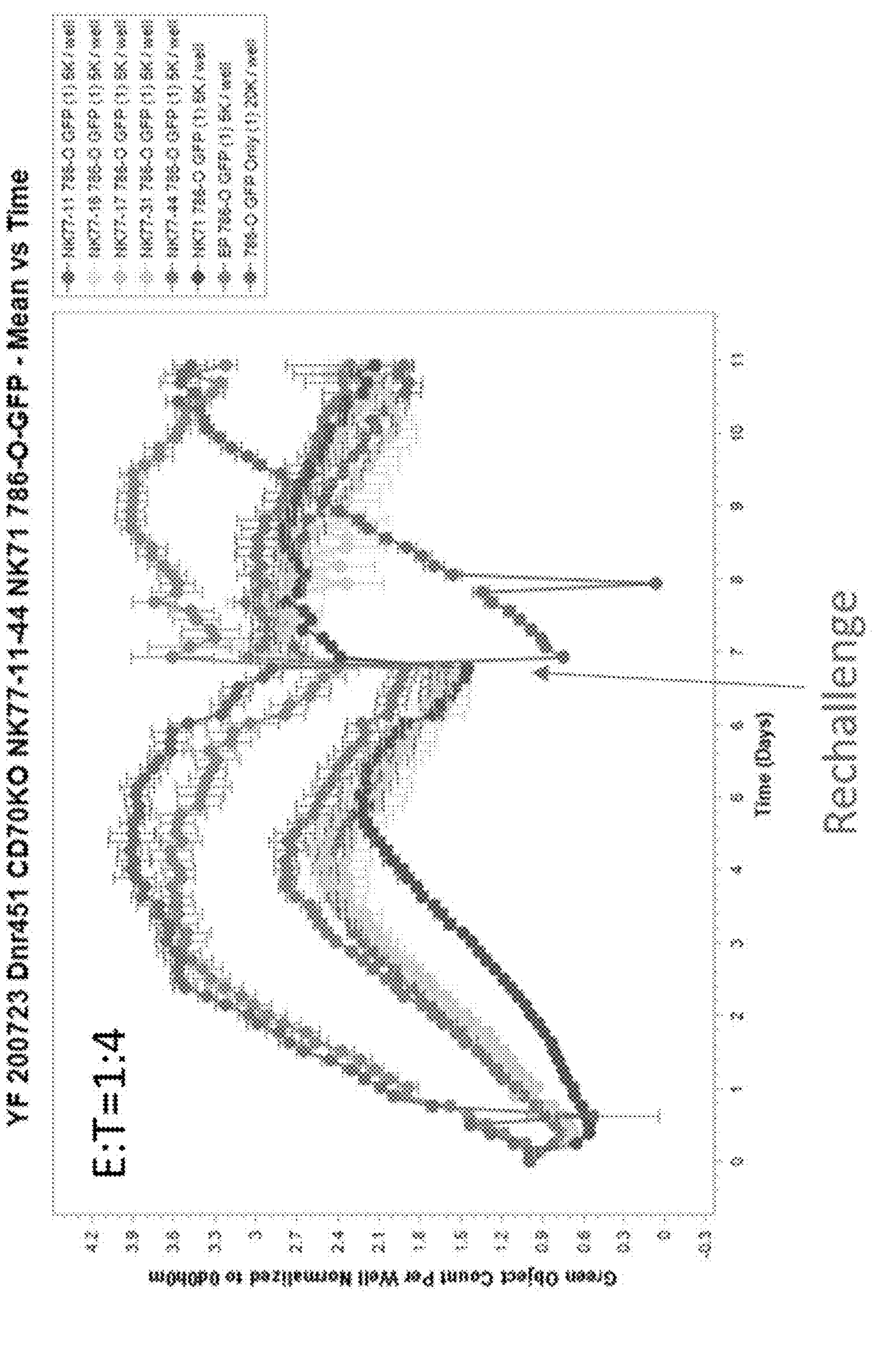

FIG. 55I shows remaining 786-O cells at 66 hours following the NK cell 1:2 co-culture as measured by 786-O GFP fluorescence. FIG. 55J shows cytotoxicity data of tested NK cells against 786-O cells at a 1:4 ratio, for up to 64 hours. FIG. 55K shows cytotoxicity data of tested NK cells against 786-O cells at a 1:4 ratio, for up to 6 days. FIG. 55L shows cytotoxicity data of tested NK cells against 786-O cells at a 1:4 ratio, for up to 7 days. FIG. 55M shows cytotoxicity data of tested NK cells against 786-O cells at a 1:4 ratio, for up to 11 days. Cultures were re-challenged with additional tumor cells at day 7.

Figure 56A:
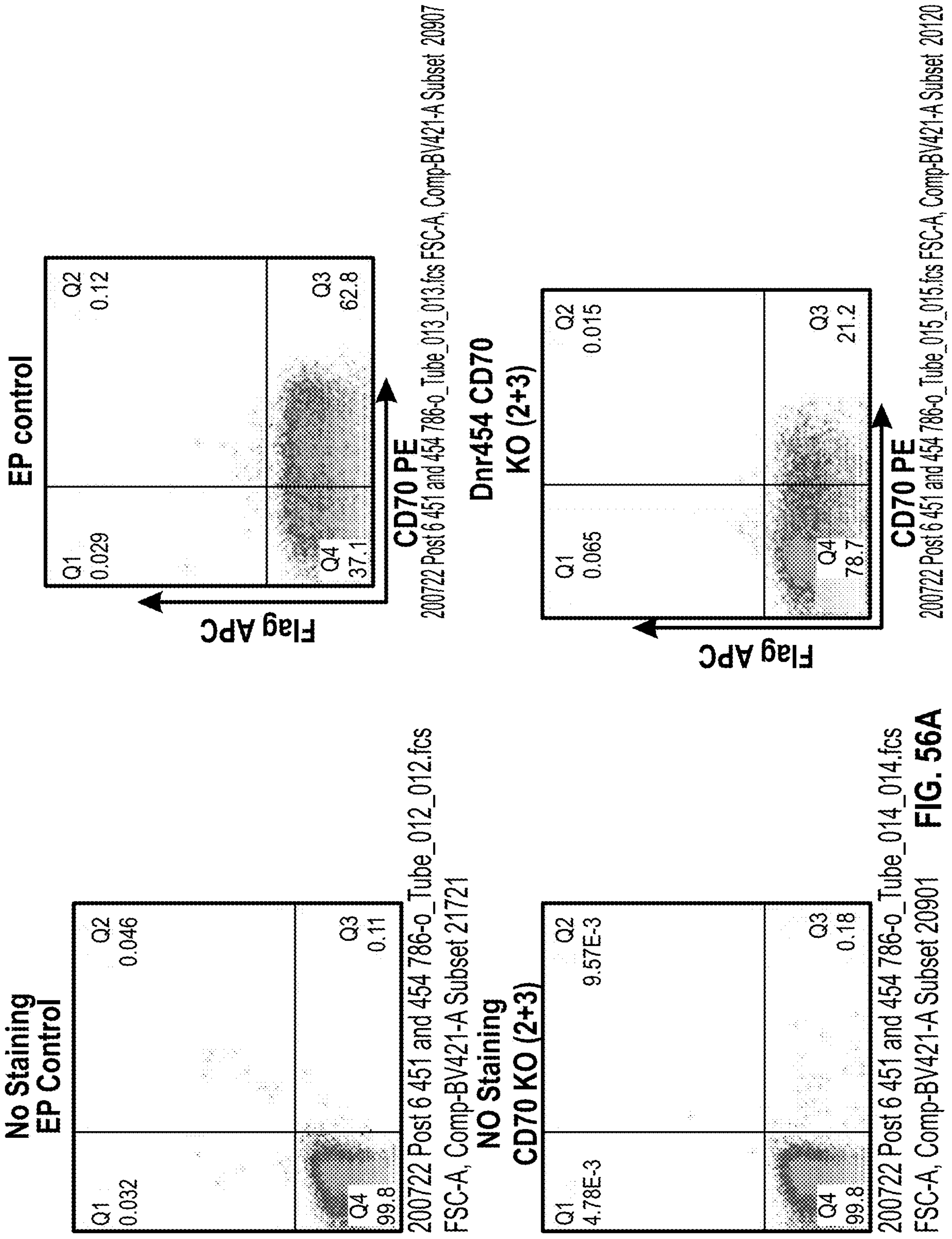
Figure 56A:
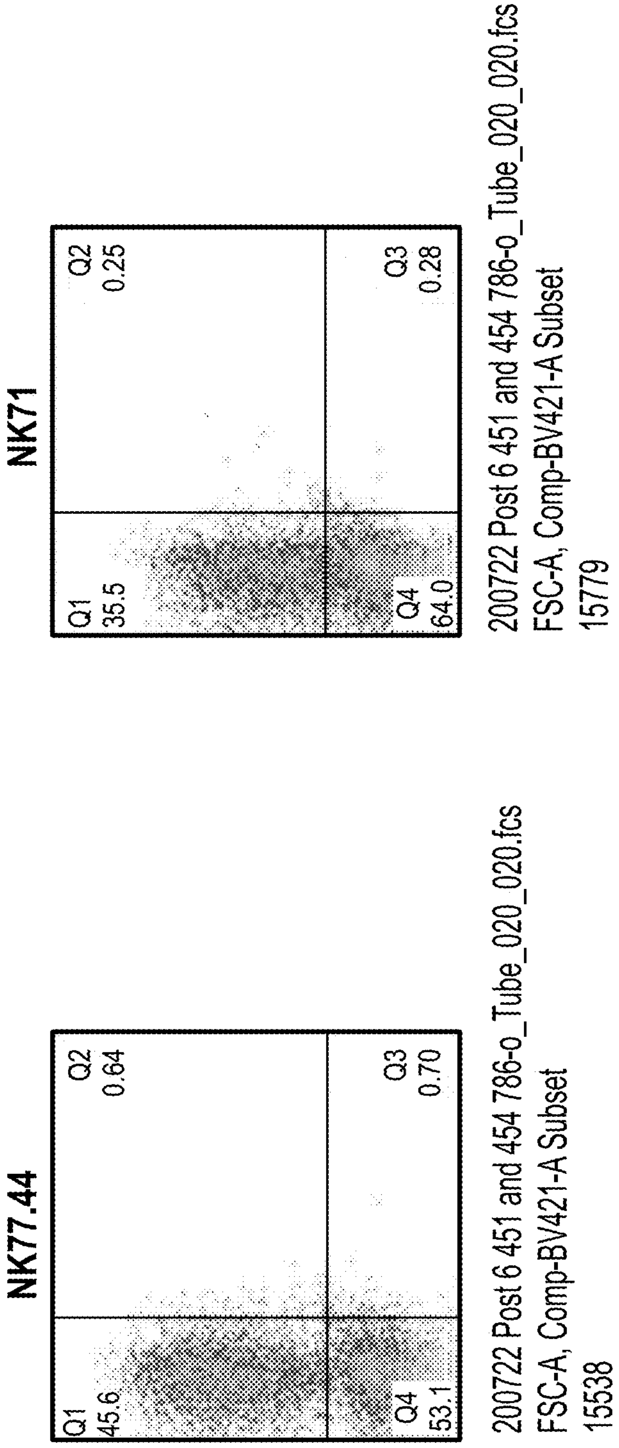
Figures 56B, 56C:
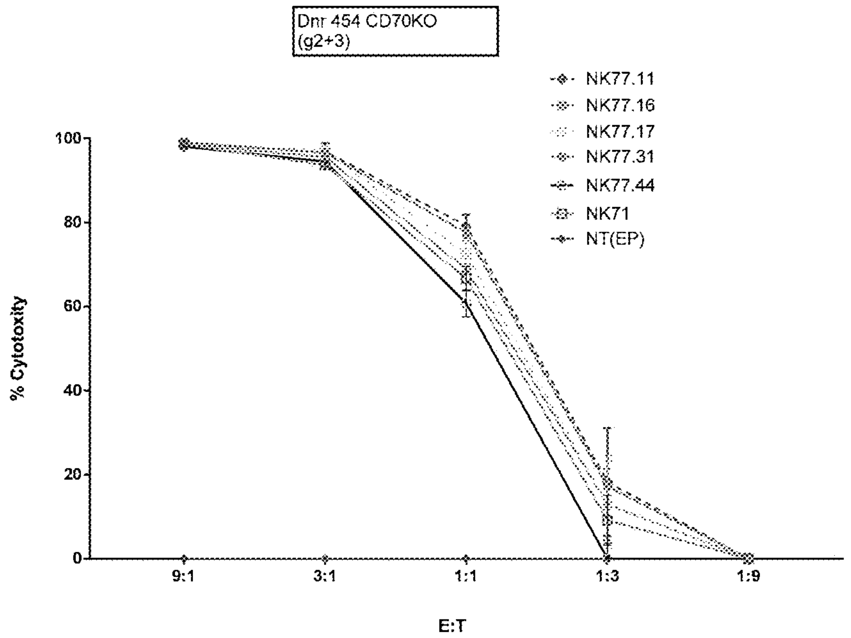
Figure 56D:
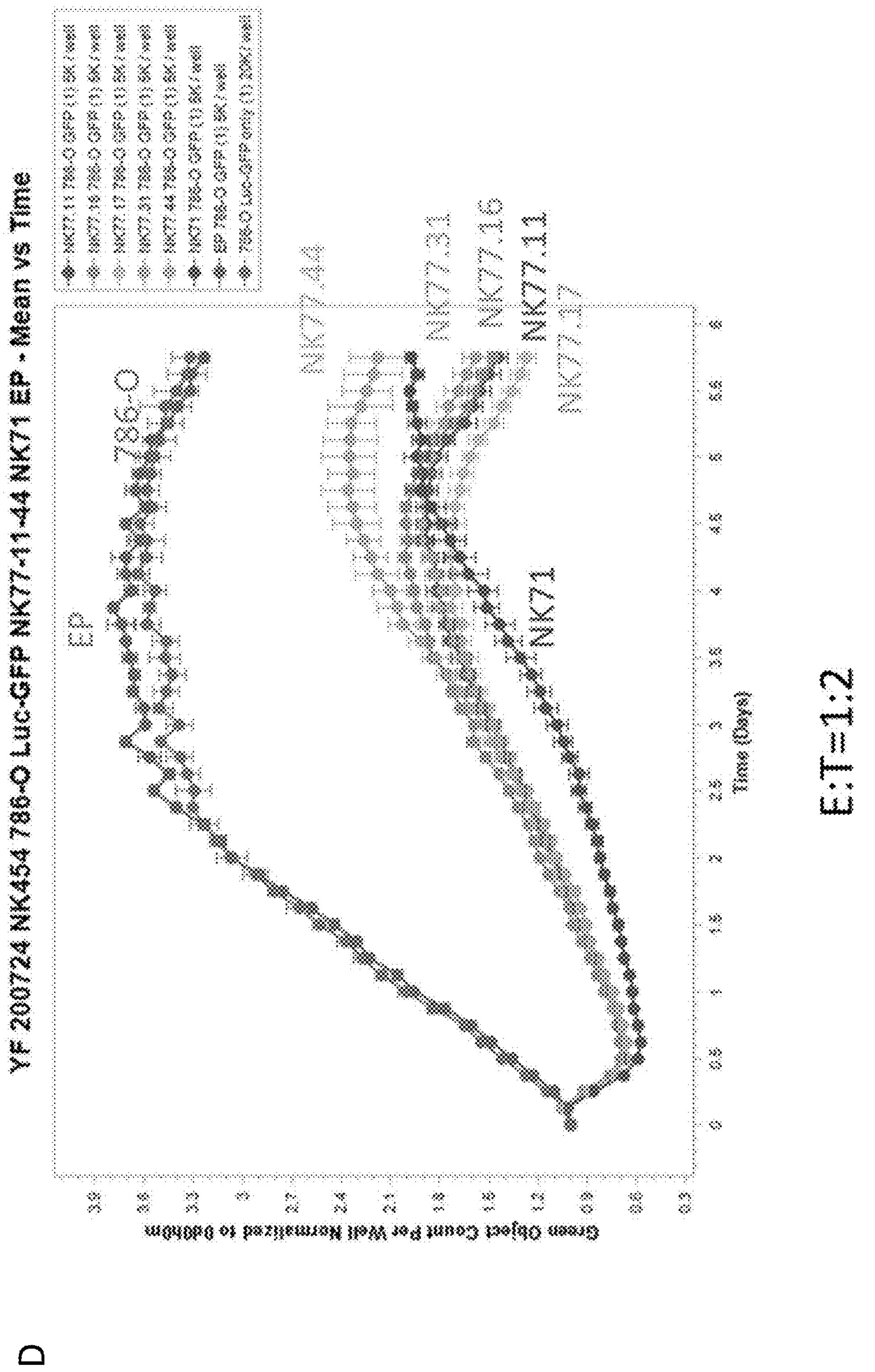
Figure 56E:
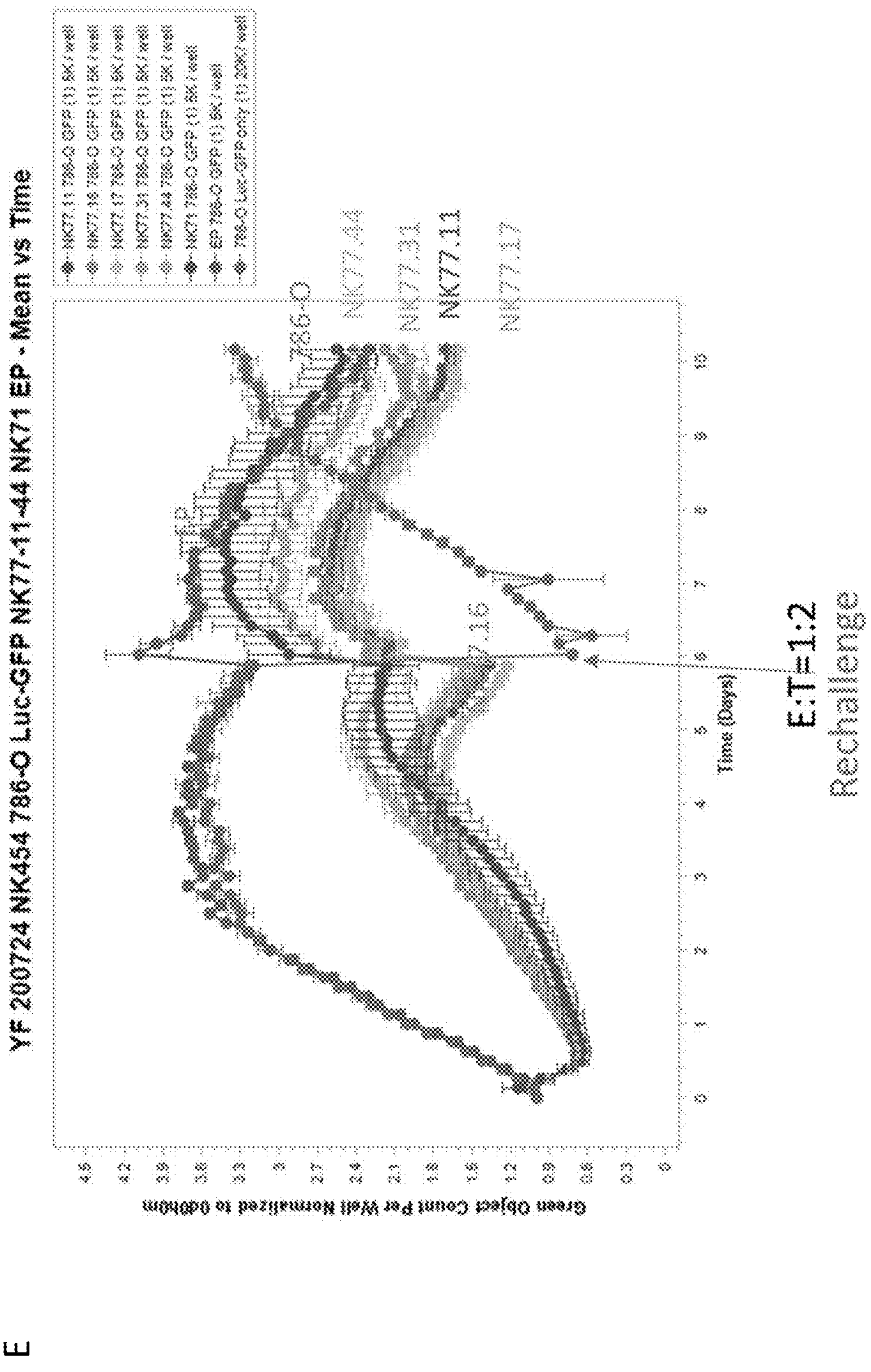
Figure 56F:
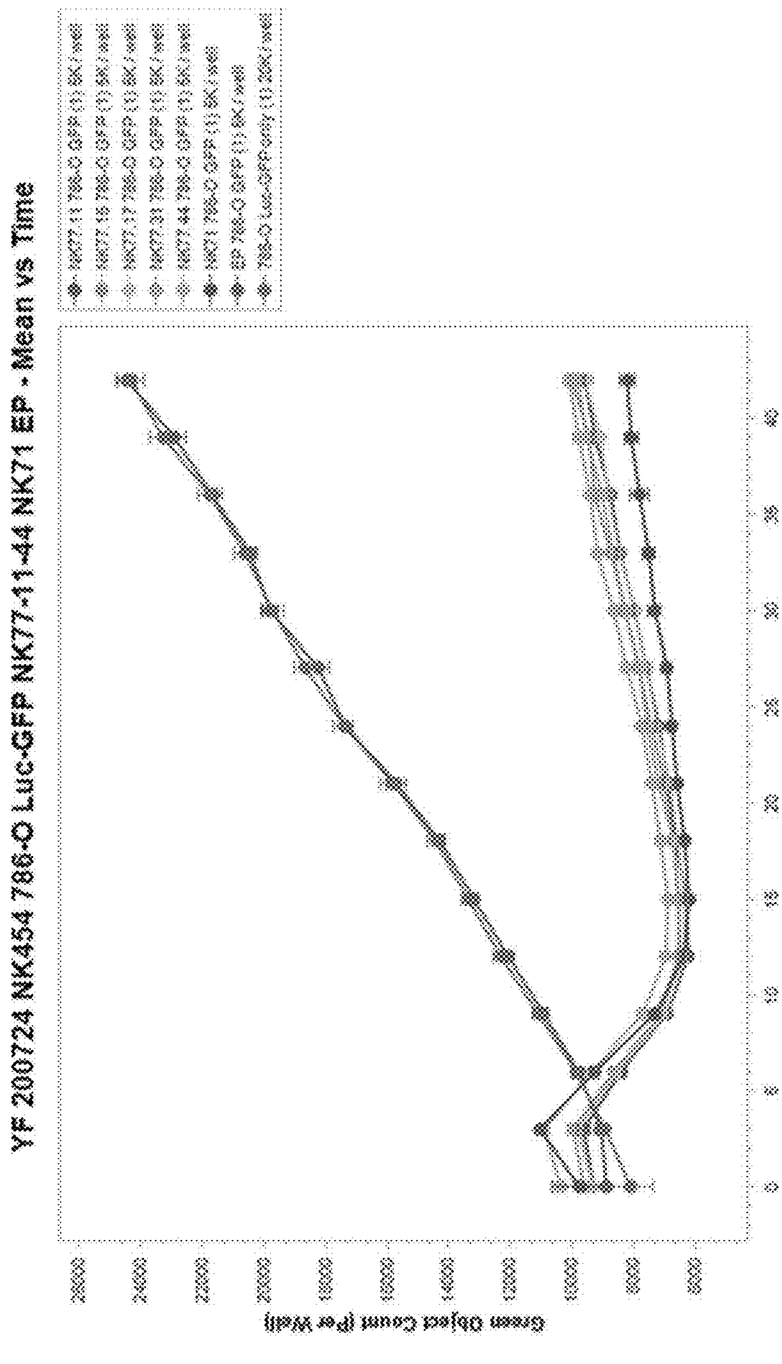
Figure 56G:
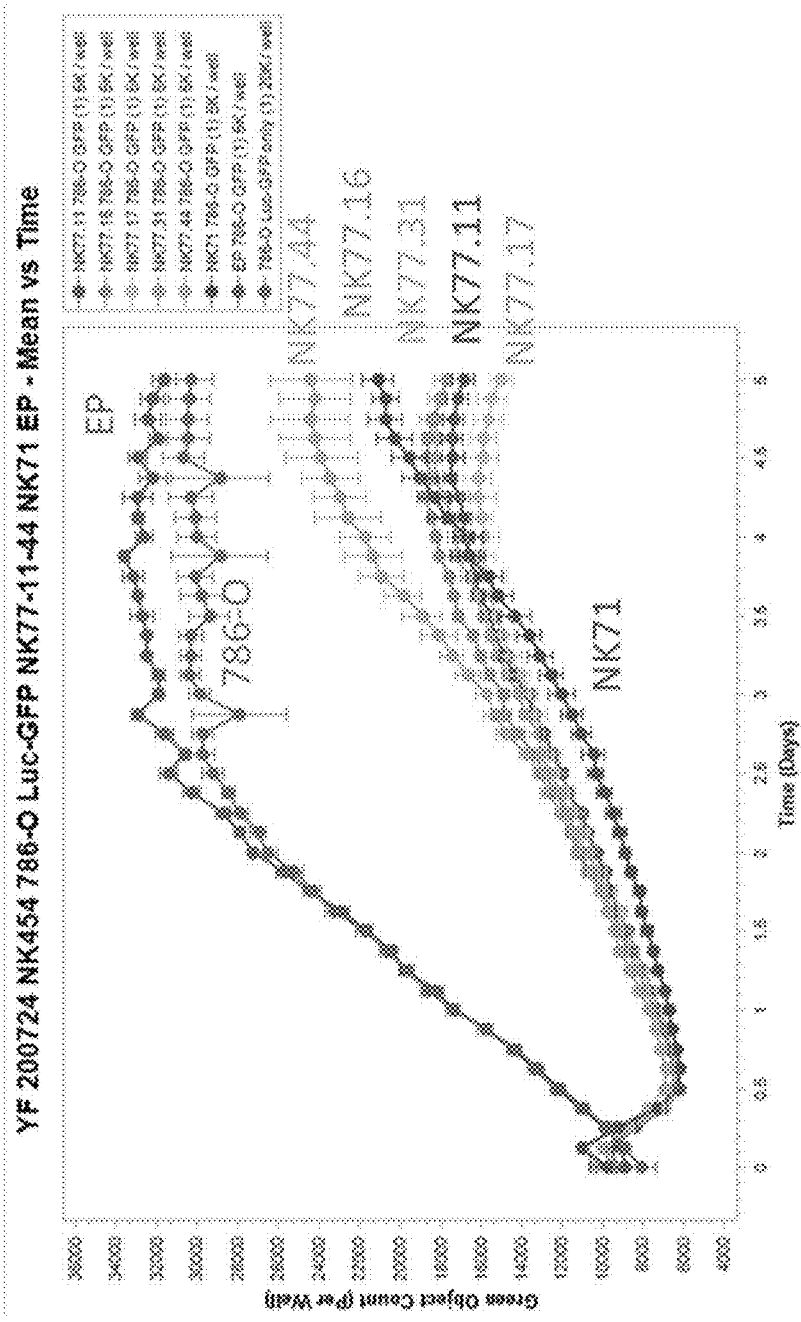
Figure 56H:
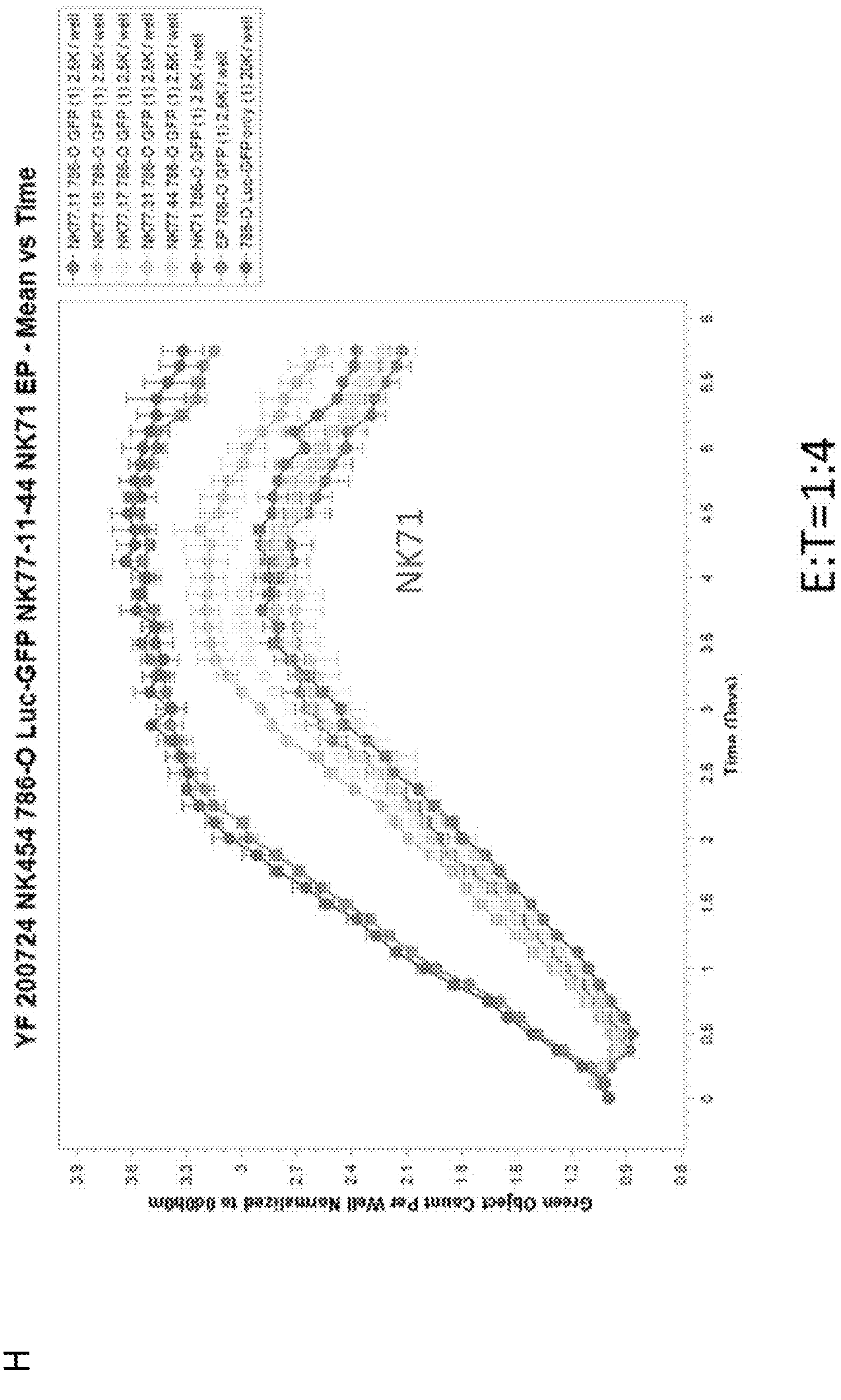
Figure 56I:
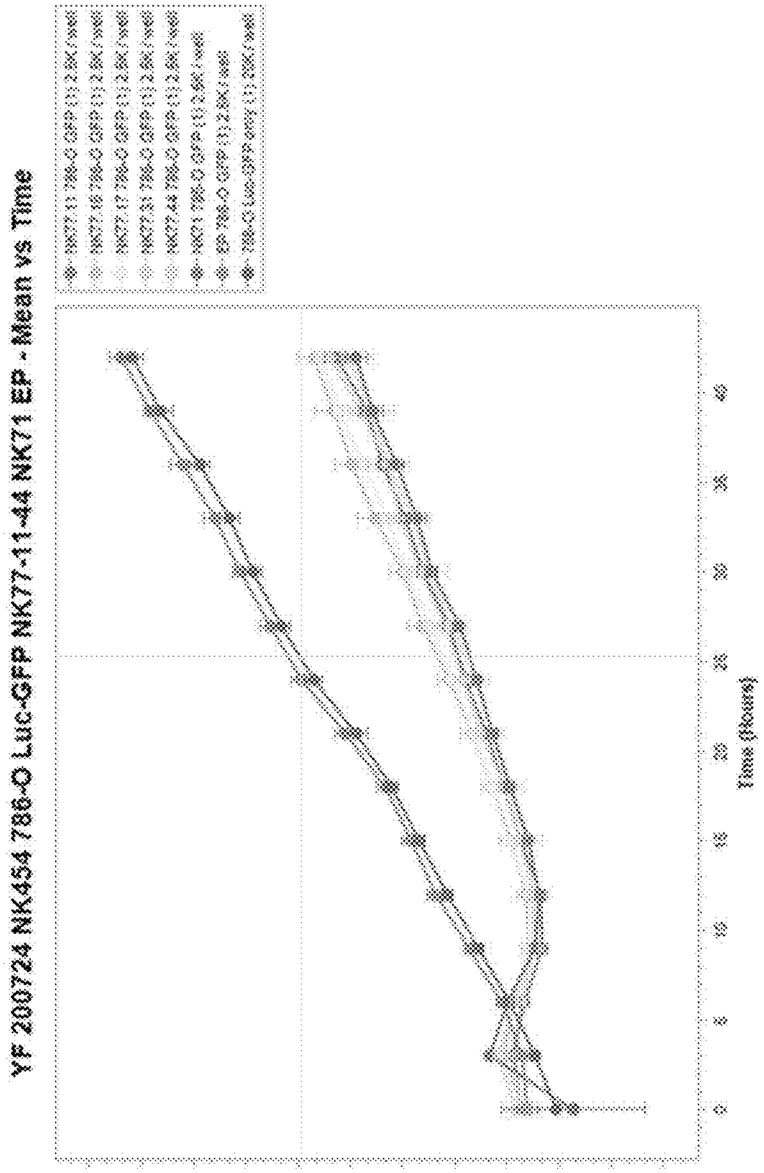
Figure 56J:
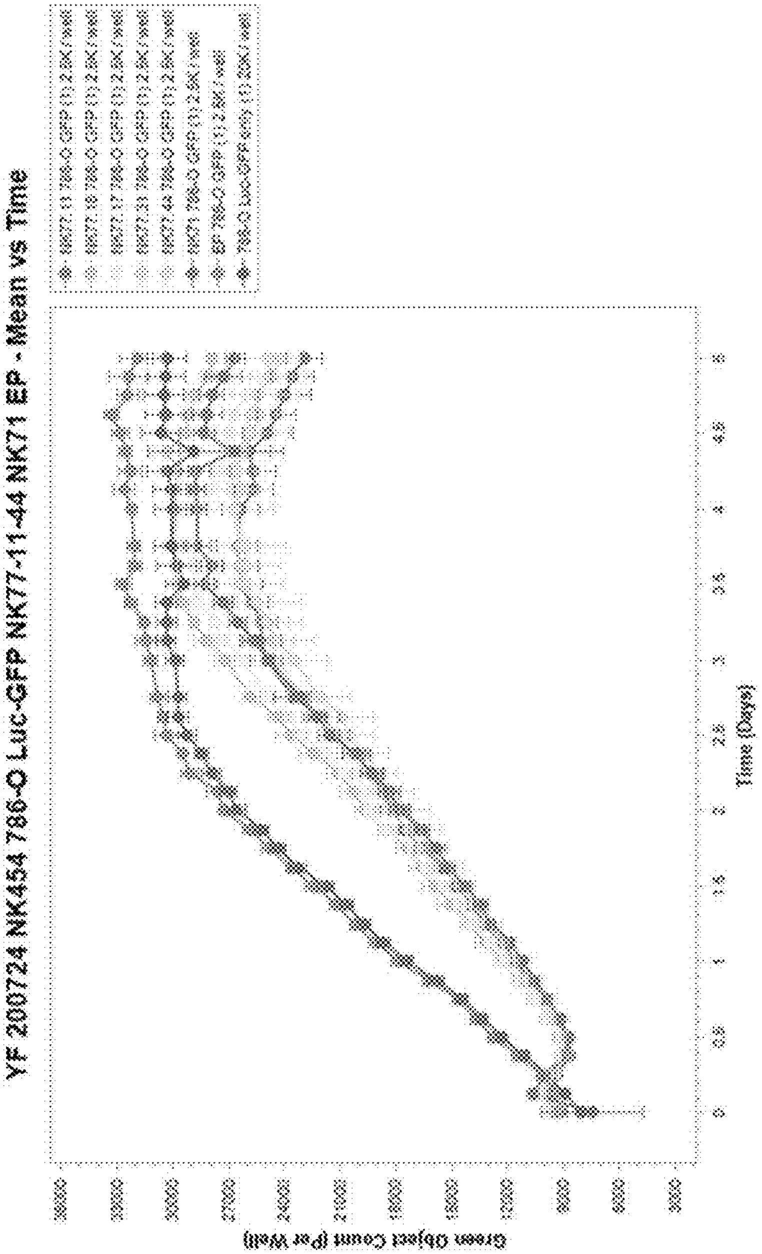

FIGS. 56A-56J show cytotoxicity data of tested anti-CD70 CARs in CD70 knockout NK cells from another donor. FIG. 56A shows flow cytometry plots detecting expression of the CAR (by APC anti-FLAG) and loss of expression of CD70 (by PE anti-CD70). FIG. 56B shows preliminary cytotoxicity data for tested NK cells against 786-O cells at different E:T ratios at 4 hours of co-culture. FIG. 56C shows quantification of the expressed anti-CD70 CAR, loss of CD70 expression, and the calculated $EC_{50}$ from the assay of FIG. 56B. FIG. 56D shows cytotoxicity data of tested NK cells against 786-O cells at a 1:2 ratio, for up to 5.75 days. FIG. 56E shows cytotoxicity data of tested NK cells as seen in FIG. 56H but extended to 10 days and re-challenge with additional tumor cells at day 6. FIG. 56F shows cytotoxicity data of tested NK cells against 786-O cells at a 1:4 ratio, for up to 42 hours. FIG. 56G shows cytotoxicity data of tested NK cells against 786-O cells at a 1:4 ratio, for up to 5 days. FIG. 56H shows cytotoxicity data of tested NK cells against 768-O cells at a 1:4 ratio, for up to 5.75 days. FIG. 56I shows cytotoxicity data of tested NK cells against 786-O cells at a 1:8 ratio, for up to 42 hours. FIG. 56J shows cytotoxicity data of tested NK cells against 786-O cells at a 1:8 ratio, for up to 5 days.

Figure 57A:
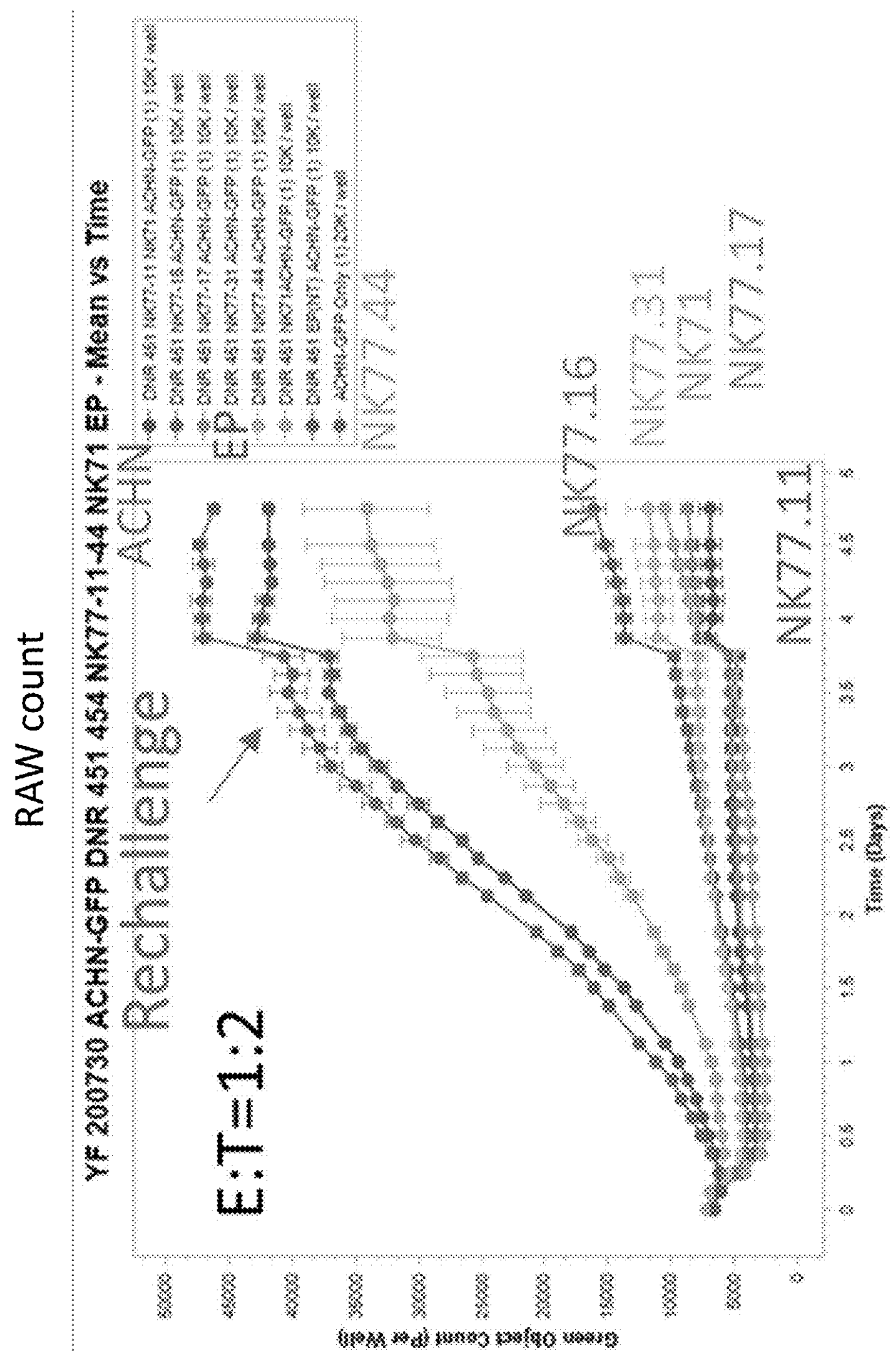
Figure 57B:
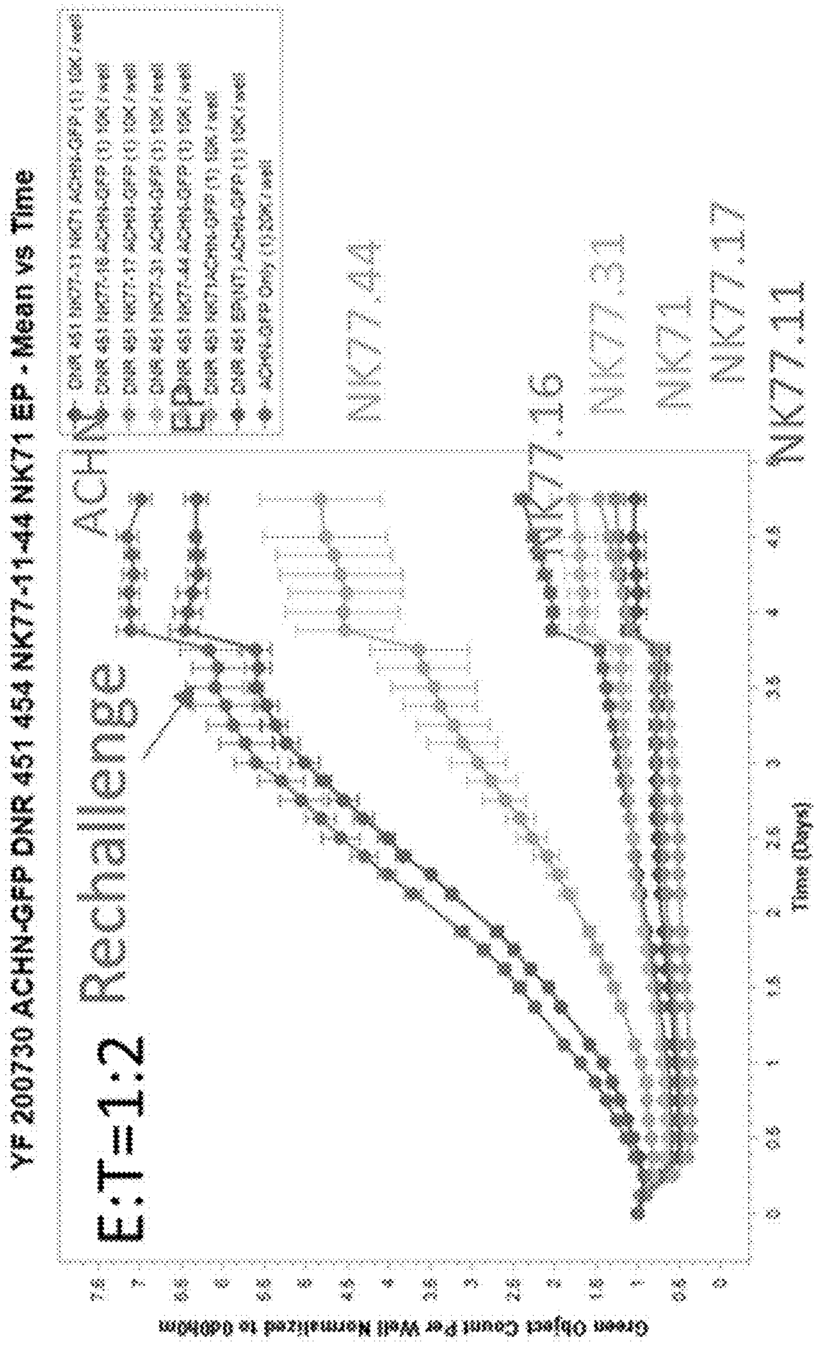
Figure 57C:
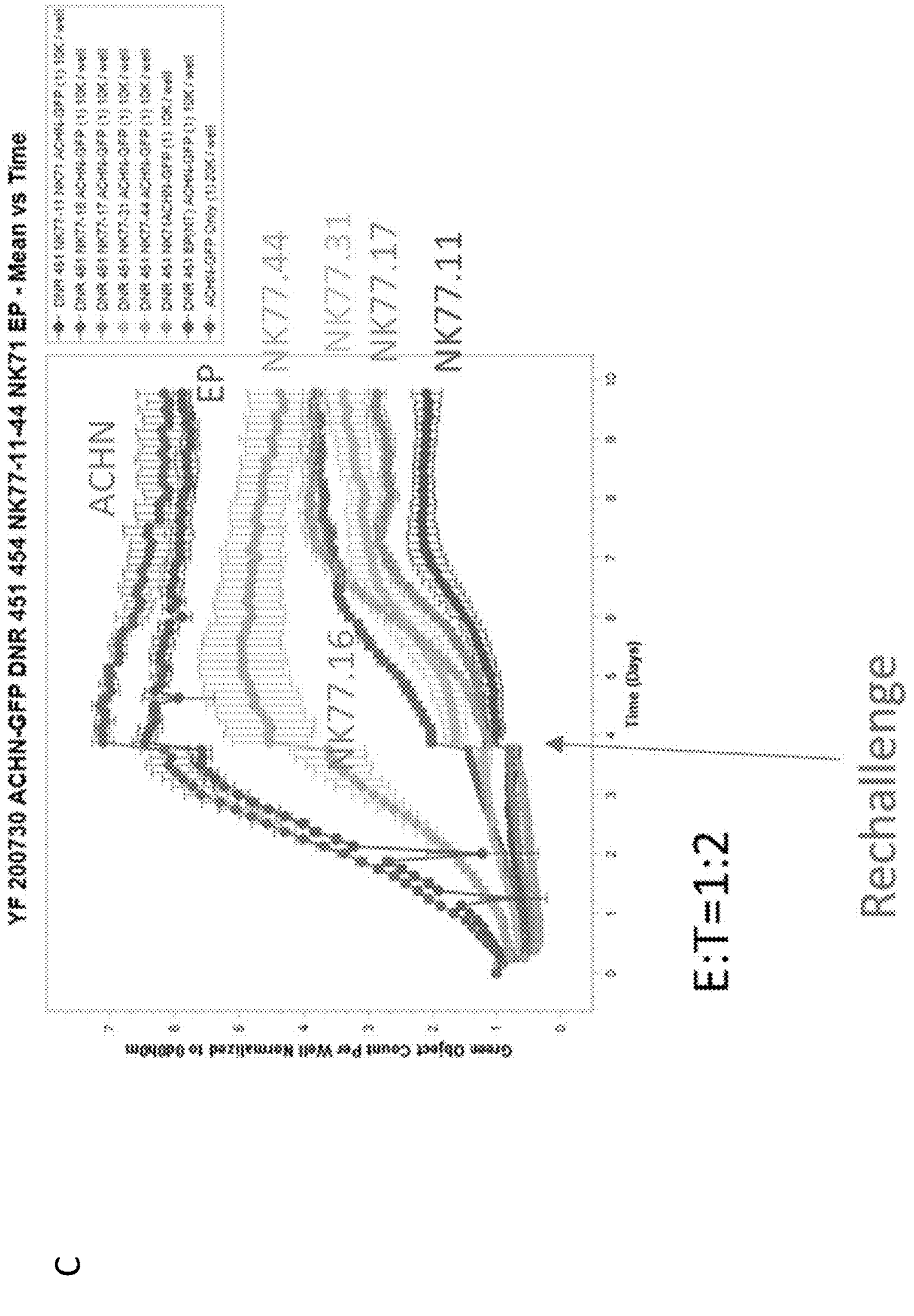
Figure 57D:
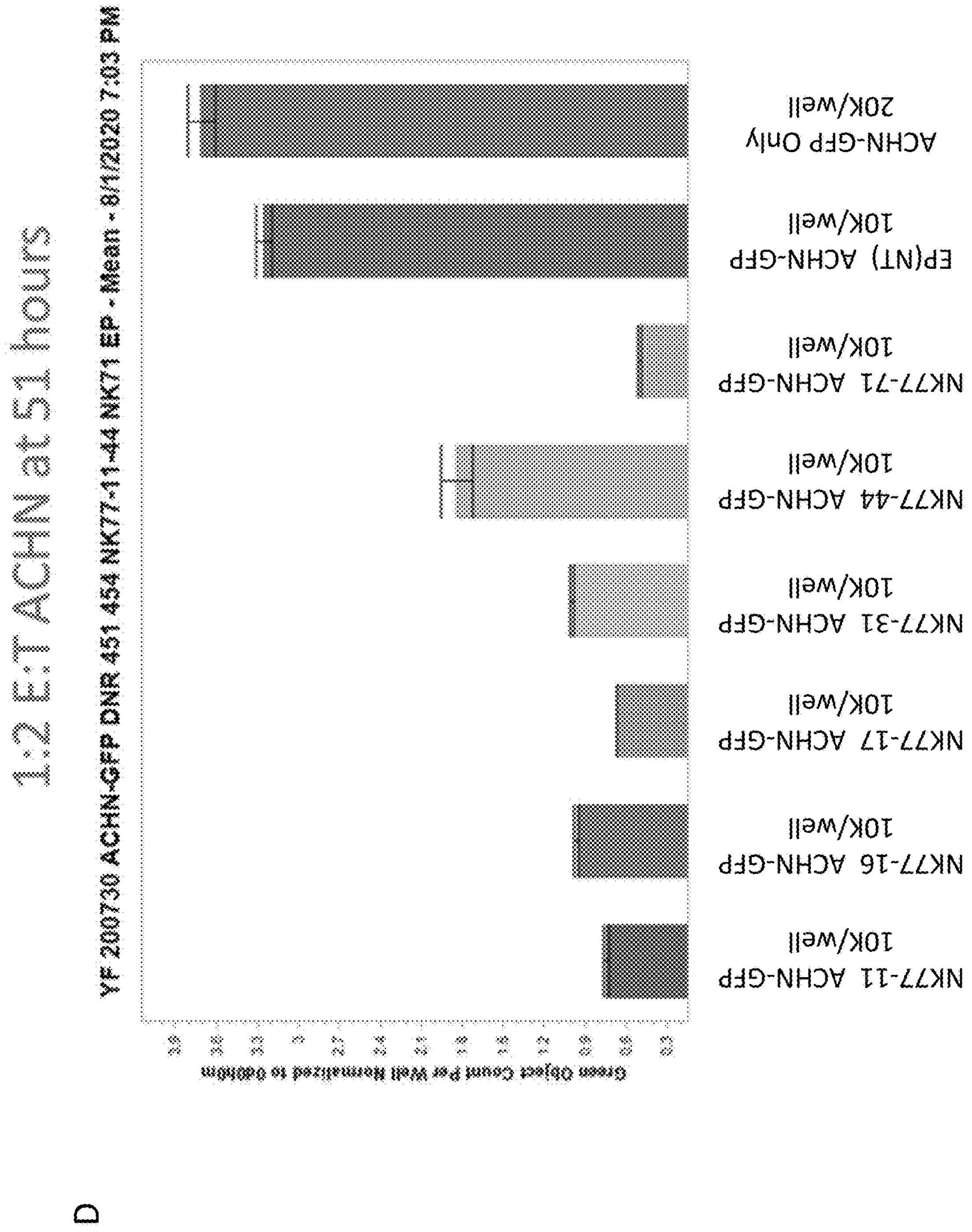
Figure 57E:
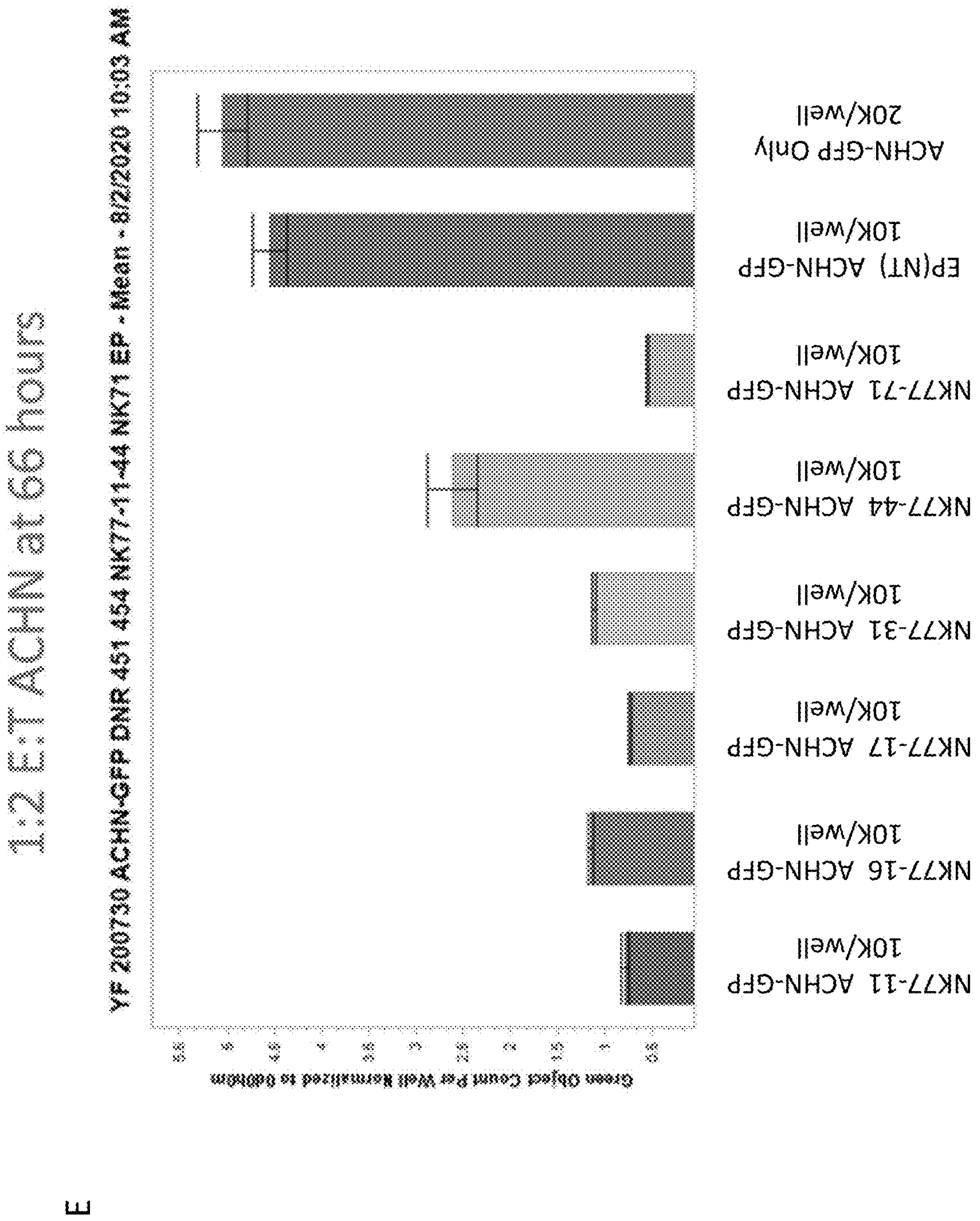
Figure 57F:
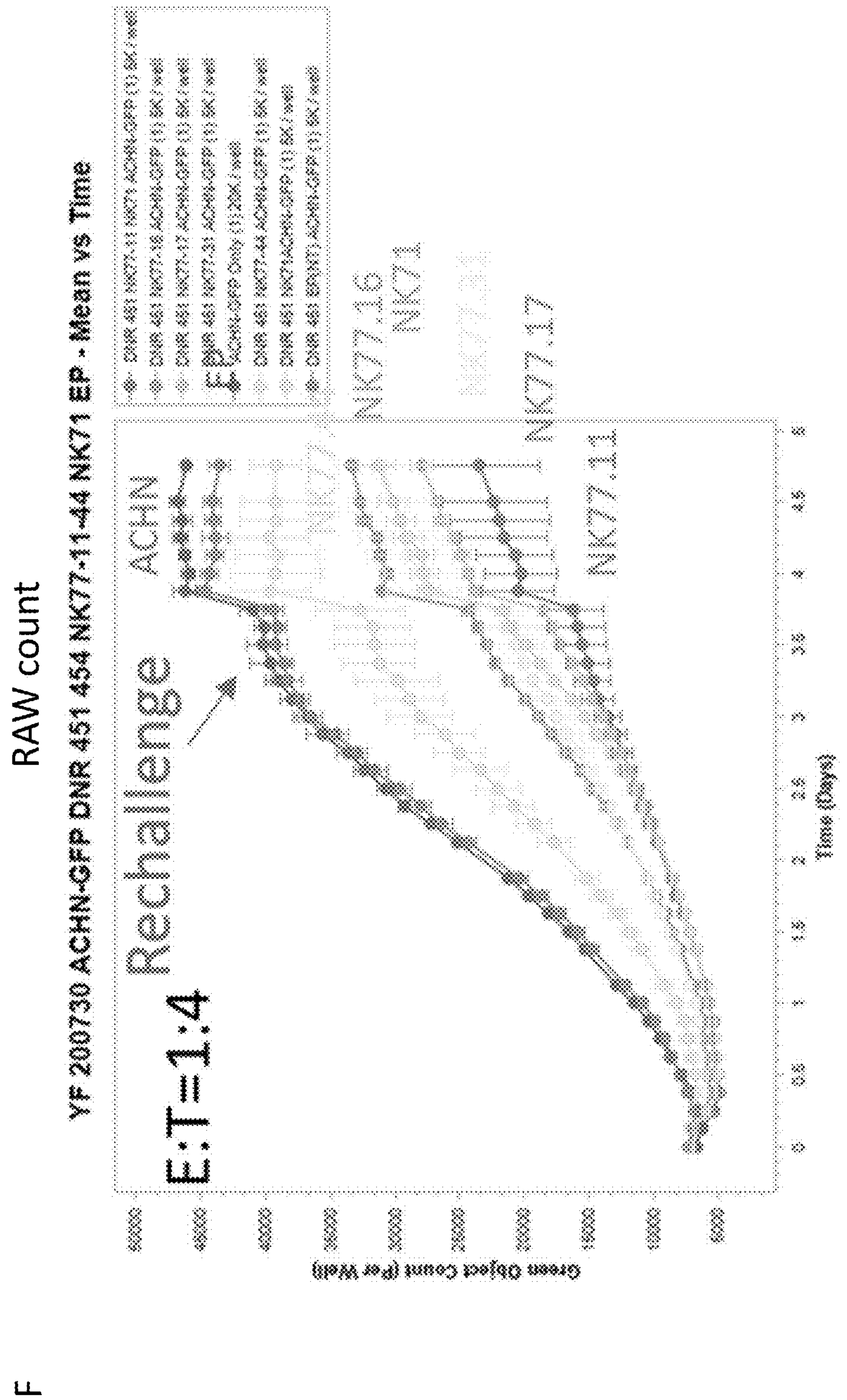
Figure 57G:
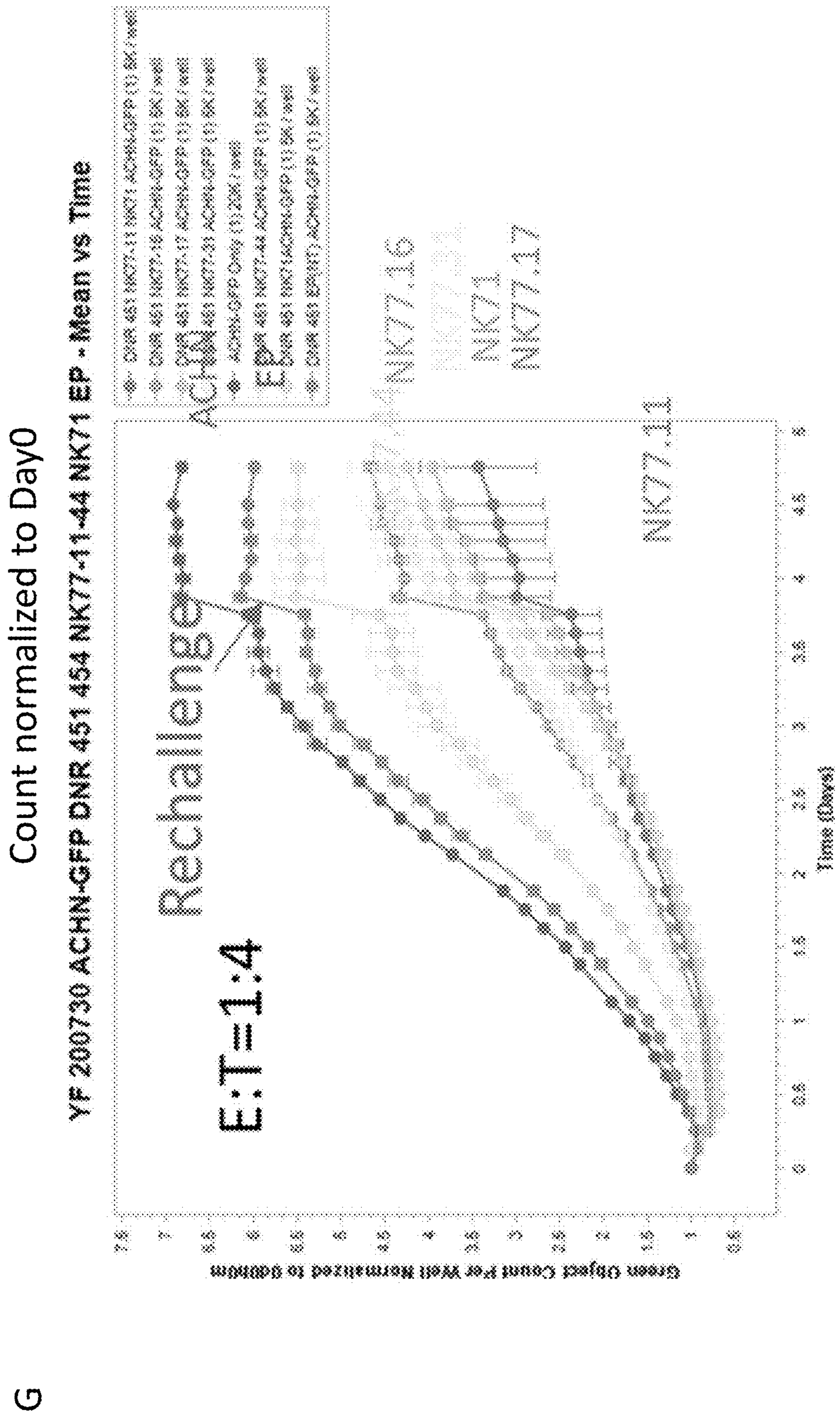
Figure 57H:
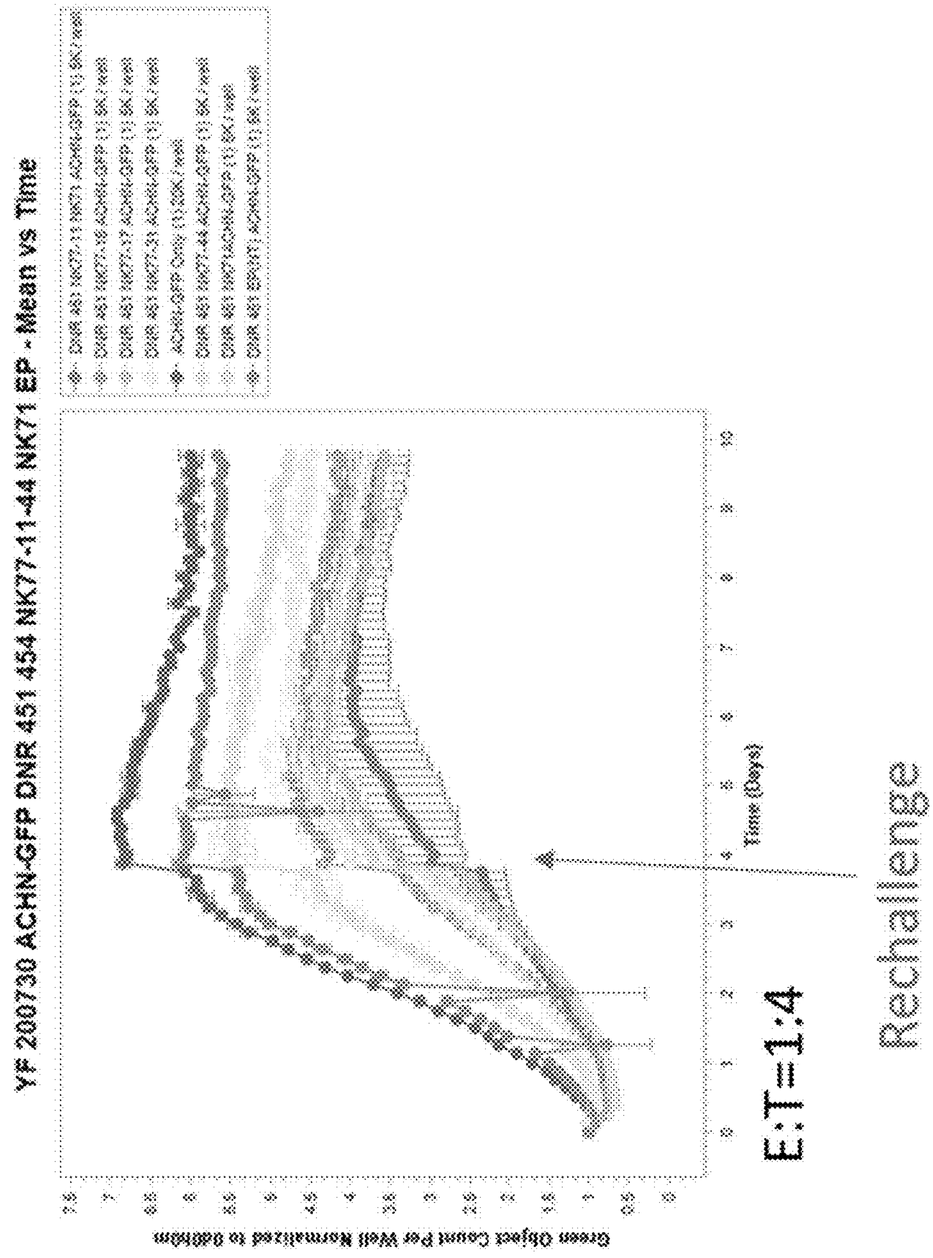

FIGS. 57A-57H show cytotoxicity data of tested anti-CD70 CARs in CD70 knockout NK cells from one donor against ACHN cells. FIG. 57A shows cytotoxicity data of tested NK cells against ACHN cells at a 1:2 ratio, for up to 5 days. Cultures were re-challenged with additional tumor cells at around 3.75 days. FIG. 57B shows the cytotoxicity data of FIG. 57A, but where cell count is normalized to day 0. FIG. 57C shows cytotoxicity data of tested NK cells of FIG. 57B over a longer time period following re-challenge. FIG. 57D shows remaining ACHN cells at 51 hours following the NK cell 1:2 co-culture as measured by ACHN fluorescence. FIG. 57E shows remaining ACHN cells at 66 hours following the NK cell 1:2 co-culture as measured by ACHN fluorescence. FIG. 57F shows cytotoxicity data of tested NK cells against ACHN cells at a 1:4 ratio, for up to 5 days. Cultures were re-challenged with additional tumor cells at around 3.75 days. FIG. 57G shows the cytotoxicity data of FIG. 57F, but where cell count is normalized to day 0. FIG. 57H shows cytotoxicity data of tested NK cells of FIG. 57G over a longer time period following re-challenge.

Figure 58A:
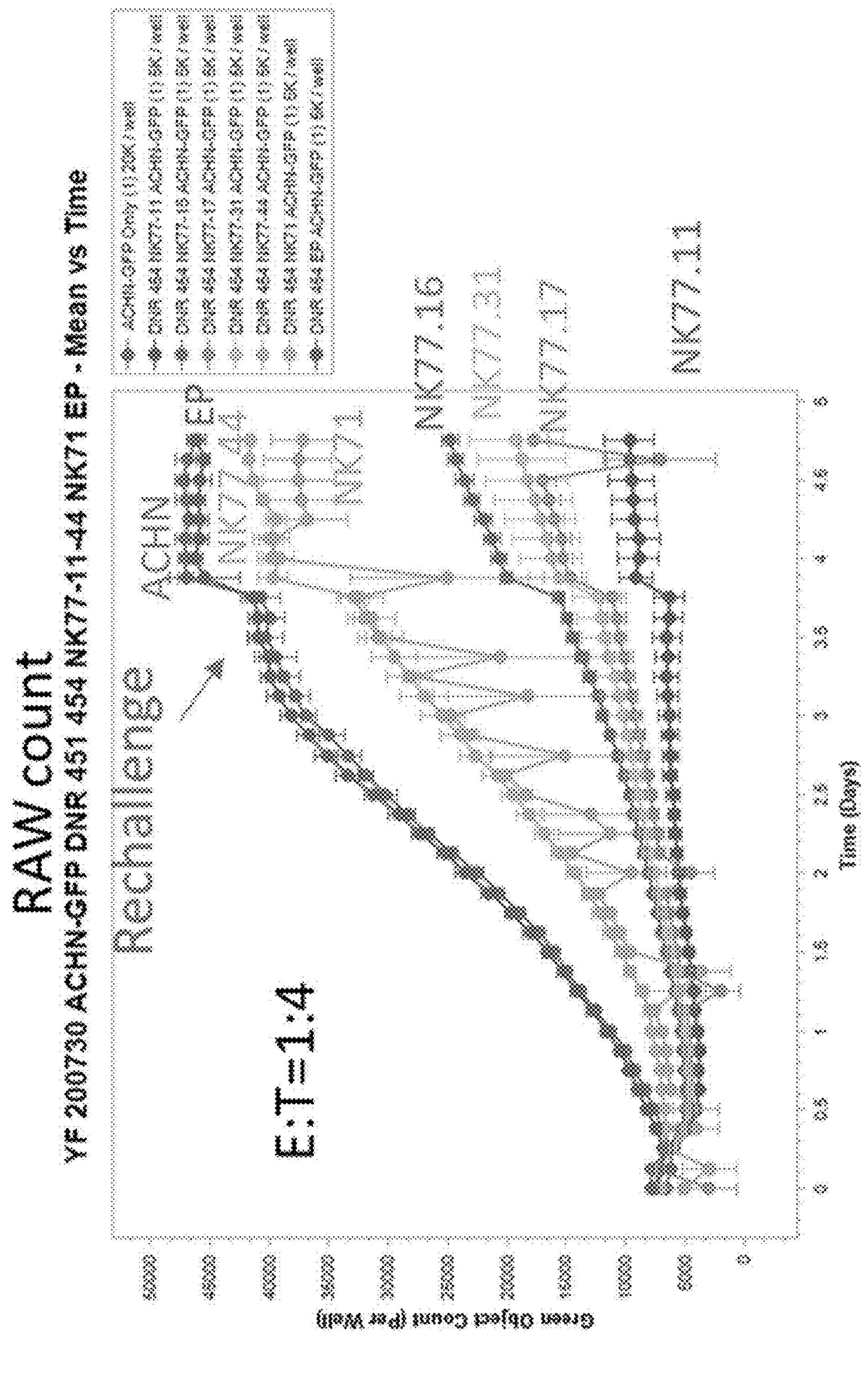
Figure 58B:
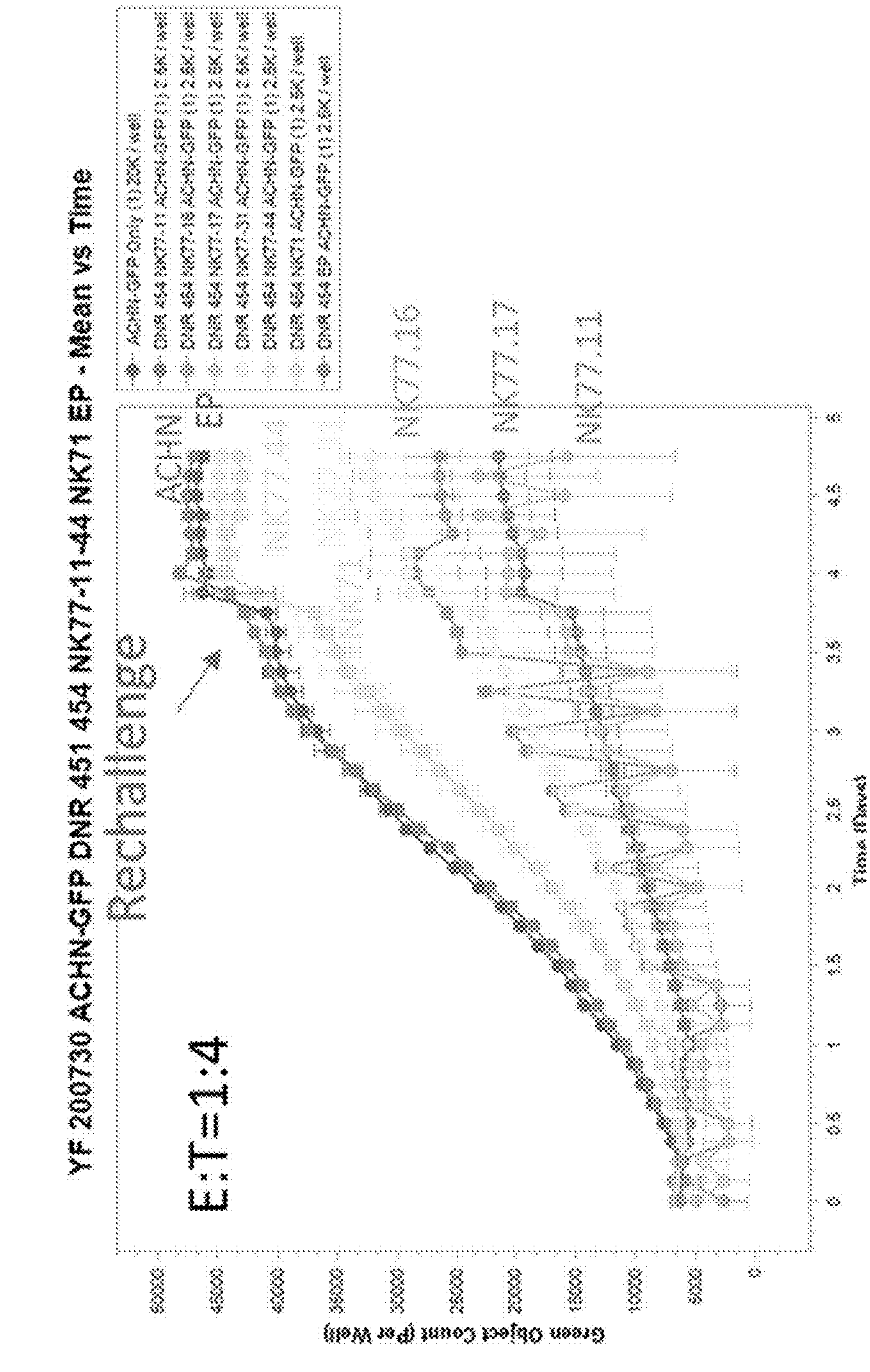
Figure 58C:
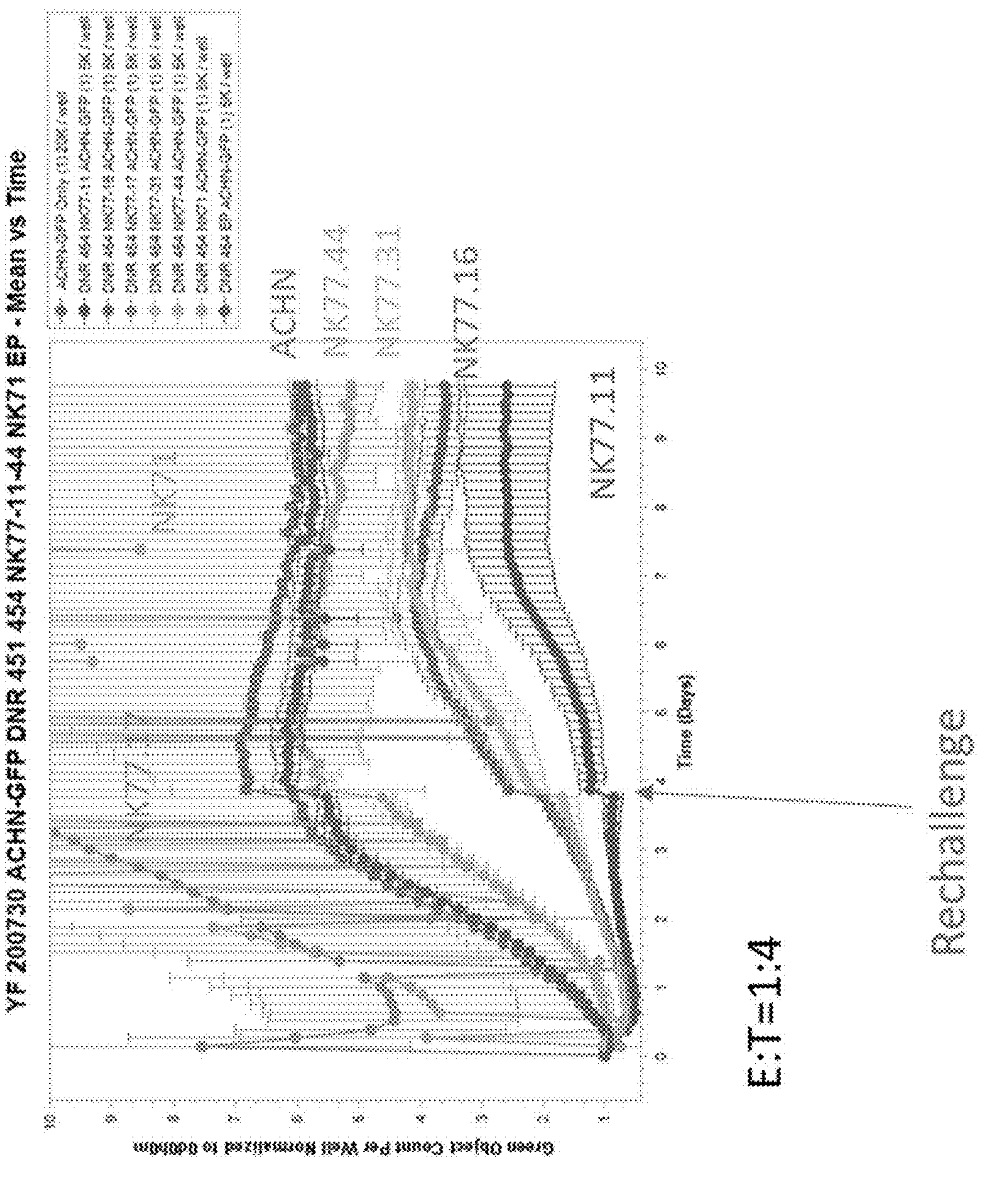
Figure 58D:
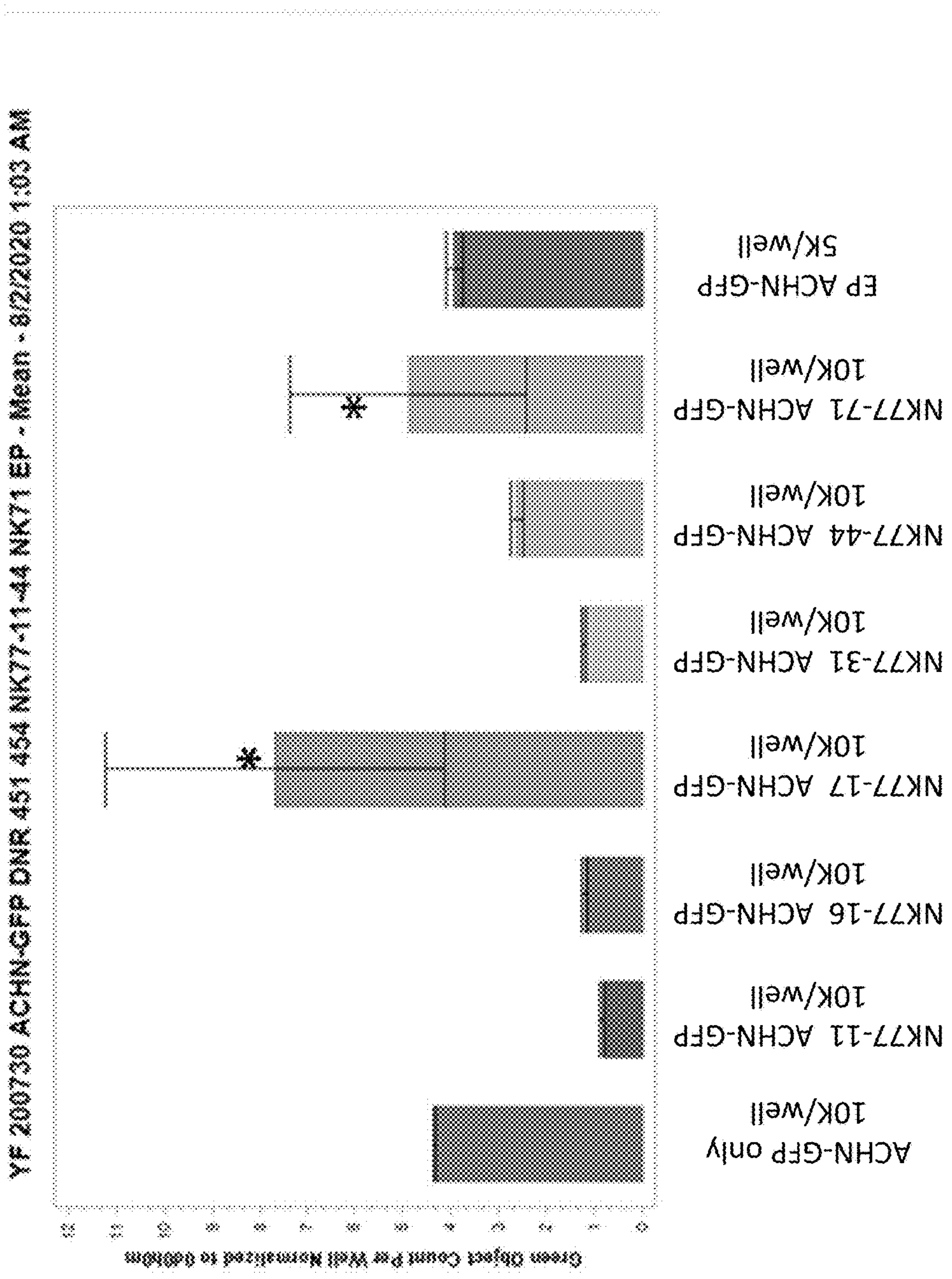
Figure 58E:
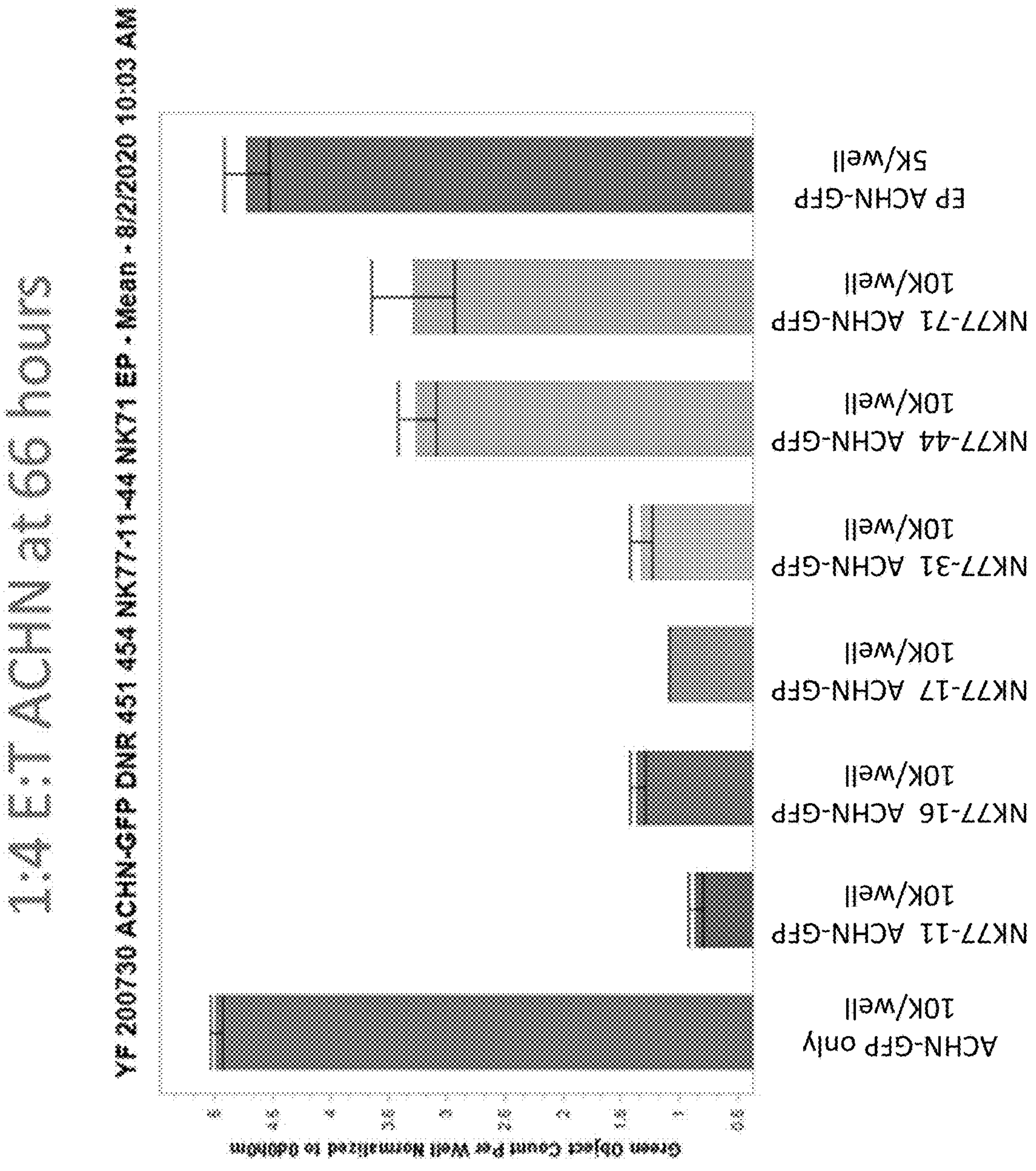
Figure 58F:
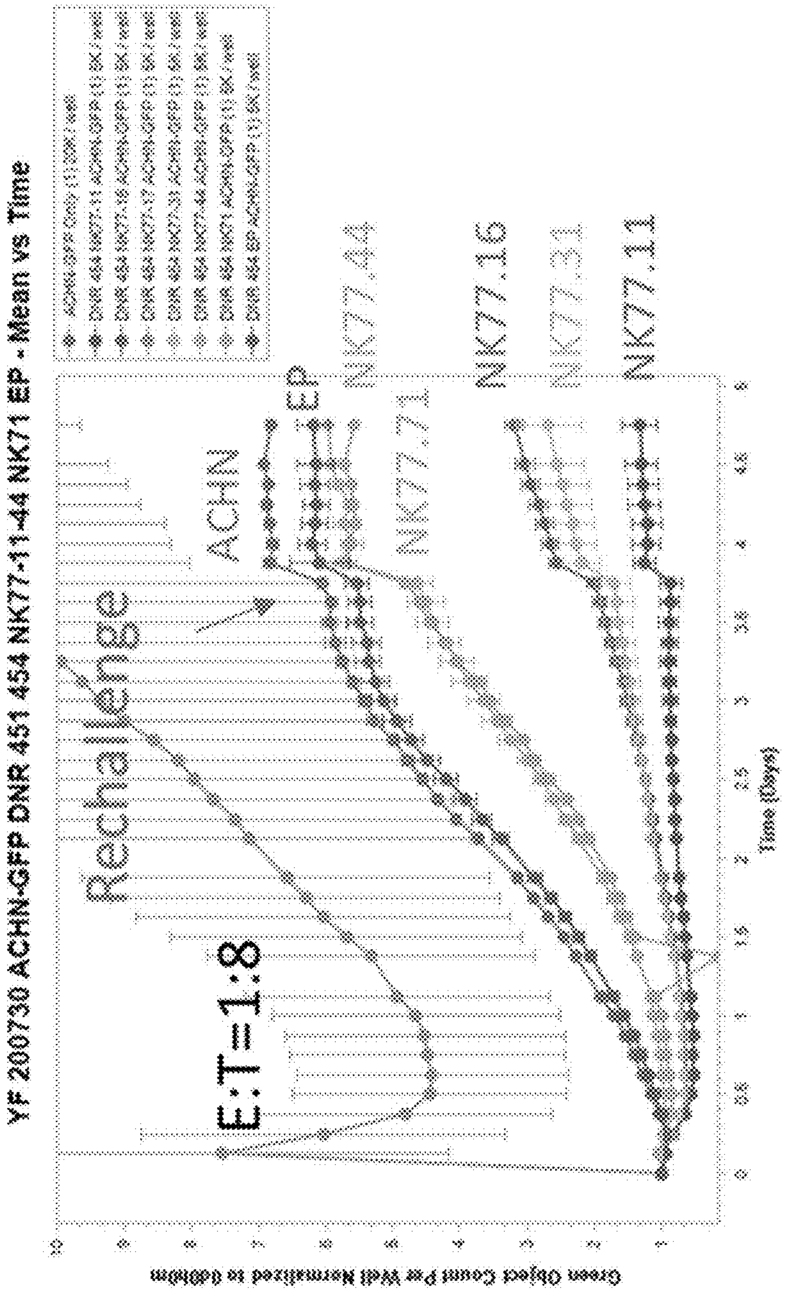
Figure 58G:
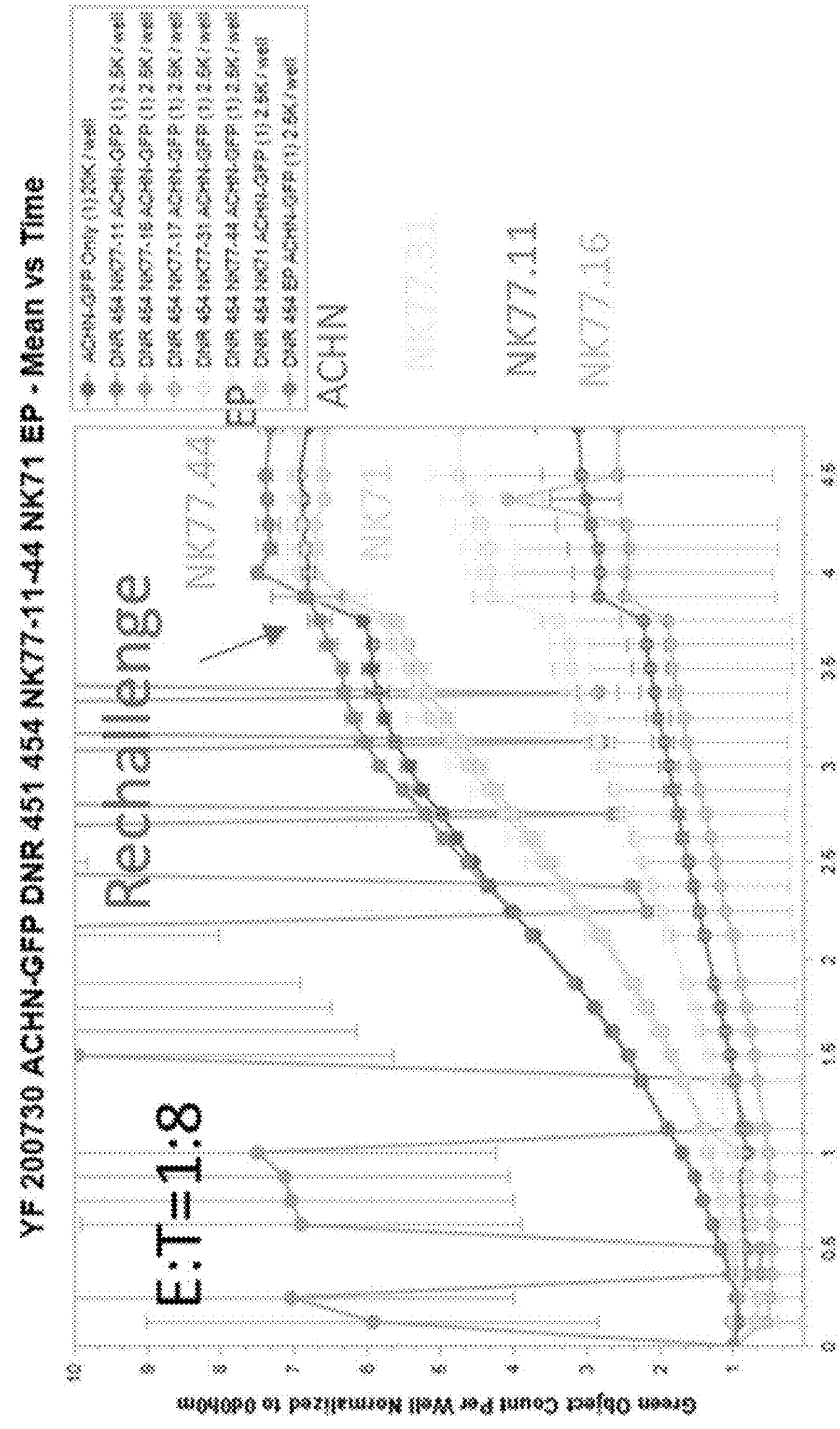
Figure 58H:
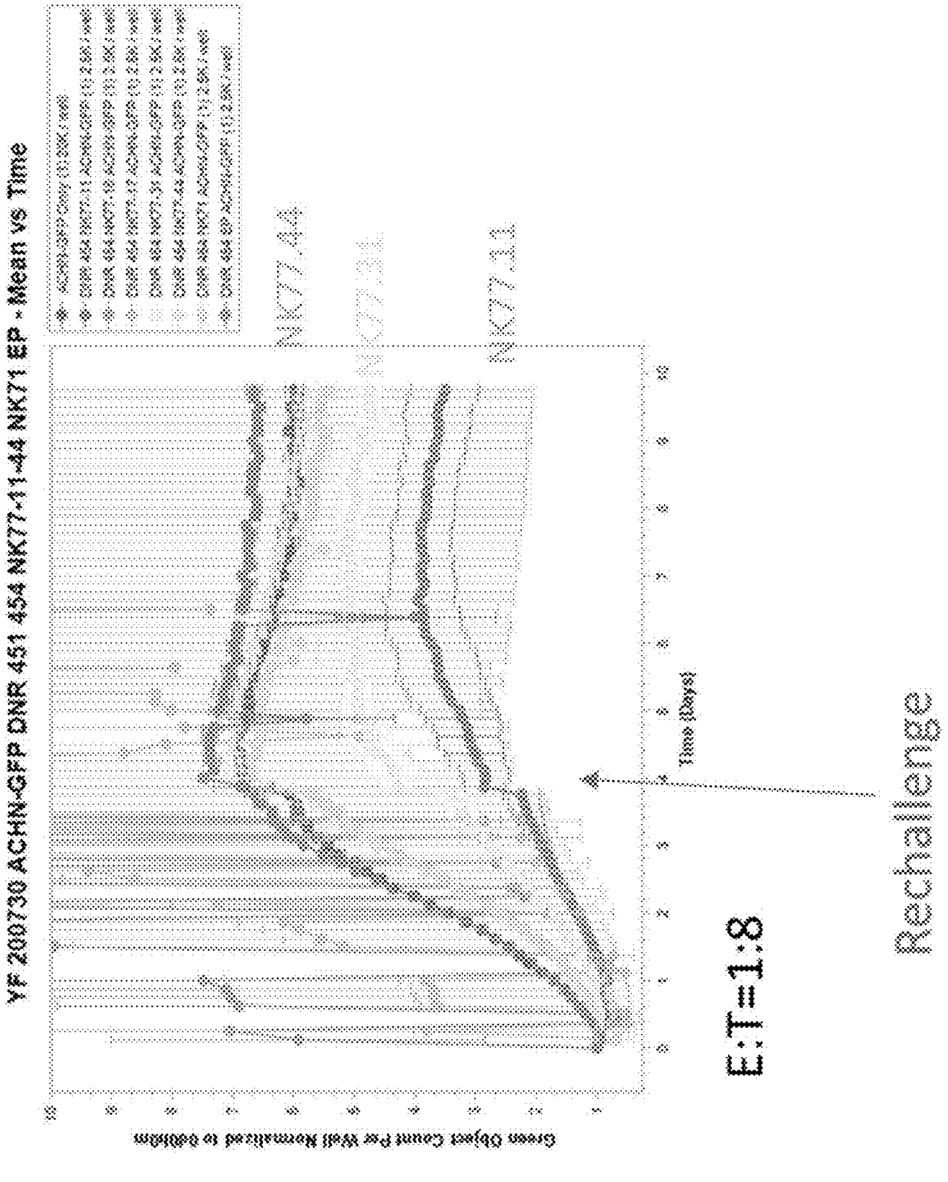

FIGS. 58A-58H show cytotoxicity data of tested anti-CD70 CARs in CD70 knockout NK cells from another donor against ACHN cells. FIG. 58A shows cytotoxicity data of tested NK cells against ACHN cells at a 1:4 ratio, for up to 5 days. Cultures were re-challenged with additional tumor cells at around 3.75 days. FIG. 58B shows the cytotoxicity data of FIG. 58A, but where cell count is normalized to day 0. FIG. 58C shows cytotoxicity data of tested NK cells of FIG. 58B over a longer time period following re-challenge. FIG. 58D shows remaining ACHN cells at 51 hours following the NK cell 1:4 co-culture as measured by ACHN fluorescence. FIG. 58E shows remaining ACHN cells at 66 hours following the NK cell 1:4 co-culture as measured by ACHN fluorescence. FIG. 58F shows cytotoxicity data of tested NK cells against ACHN cells at a 1:8 ratio, for up to 5 days. Cultures were re-challenged with additional tumor cells at around 3.75 days. FIG. 58G shows the cytotoxicity data of FIG. 58D, but where cell count is normalized to day 0. FIG. 58H shows cytotoxicity data of tested NK cells of FIG. 58G over a longer time period following re-challenge.

Figure 59A:
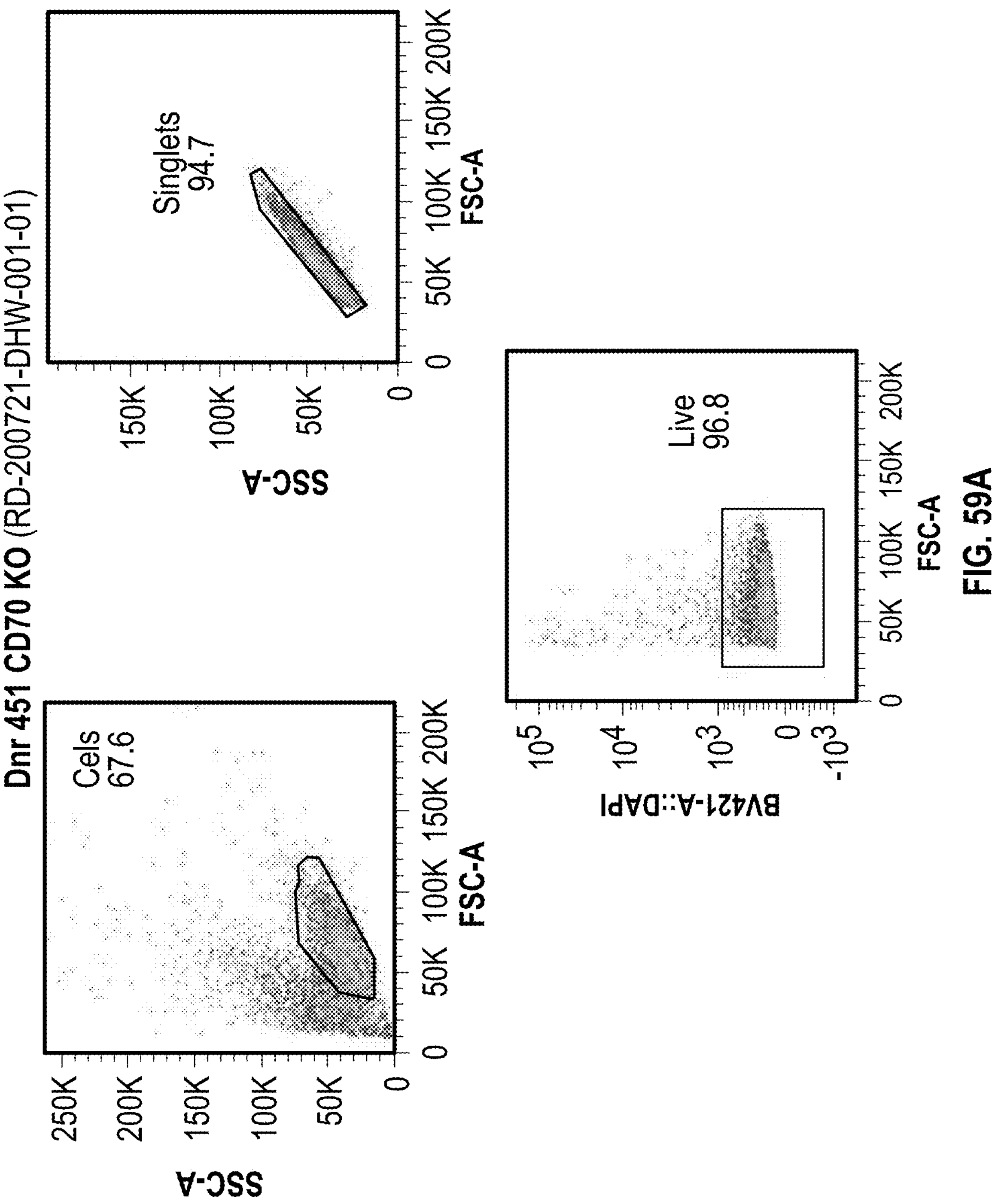
Figure 59A:
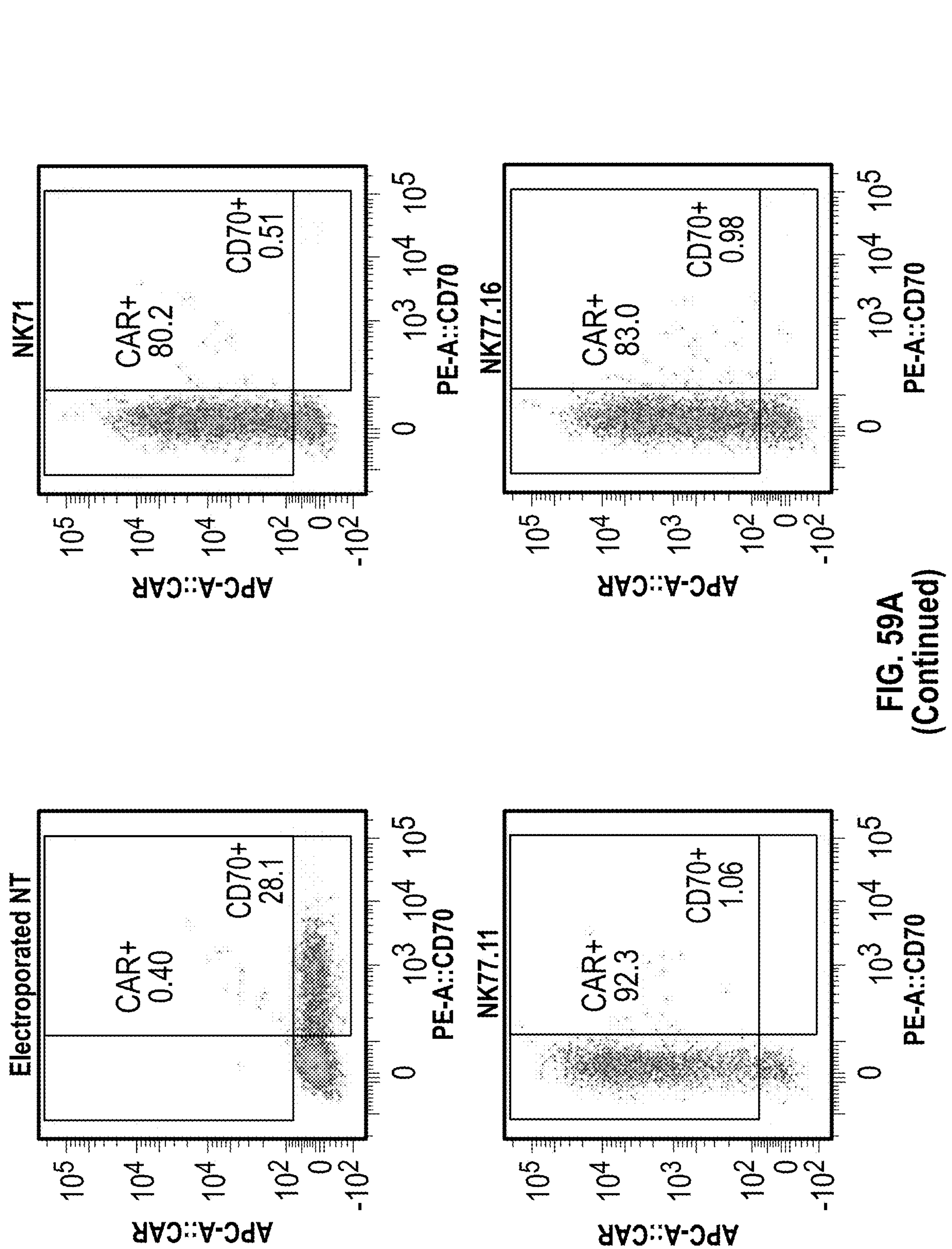
Figure 59A:
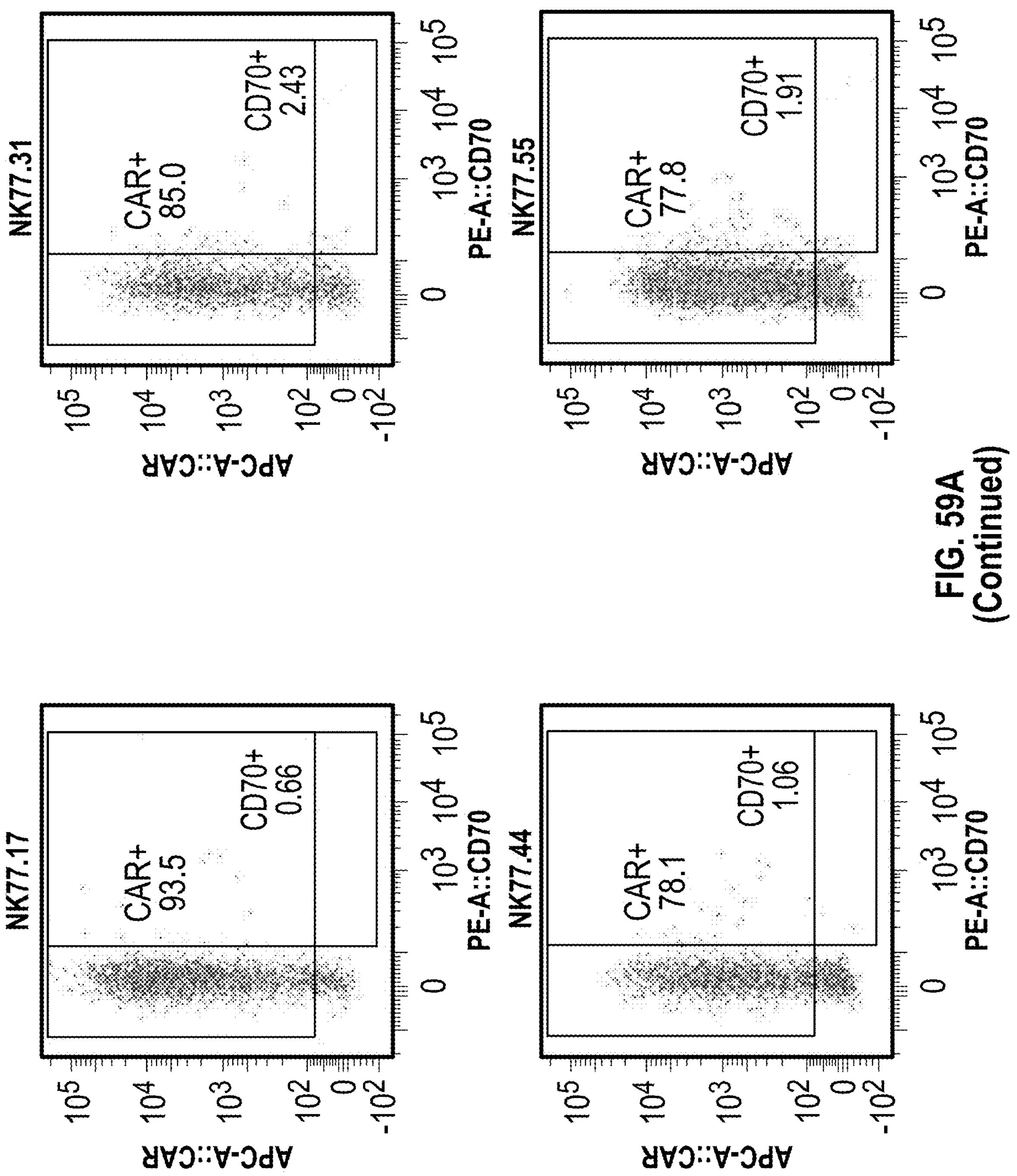
Figure 59A:
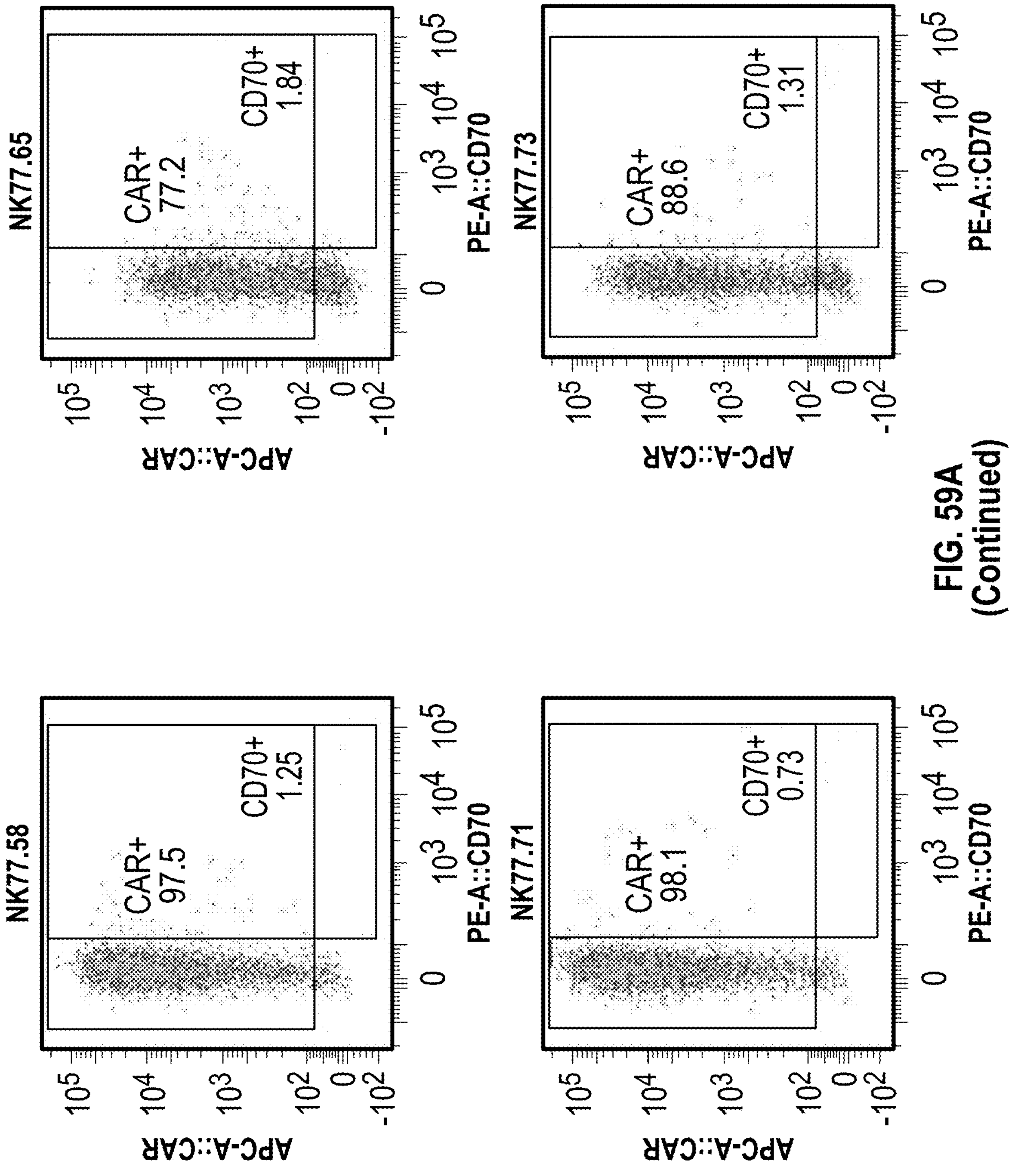
Figures 59B, 59C:
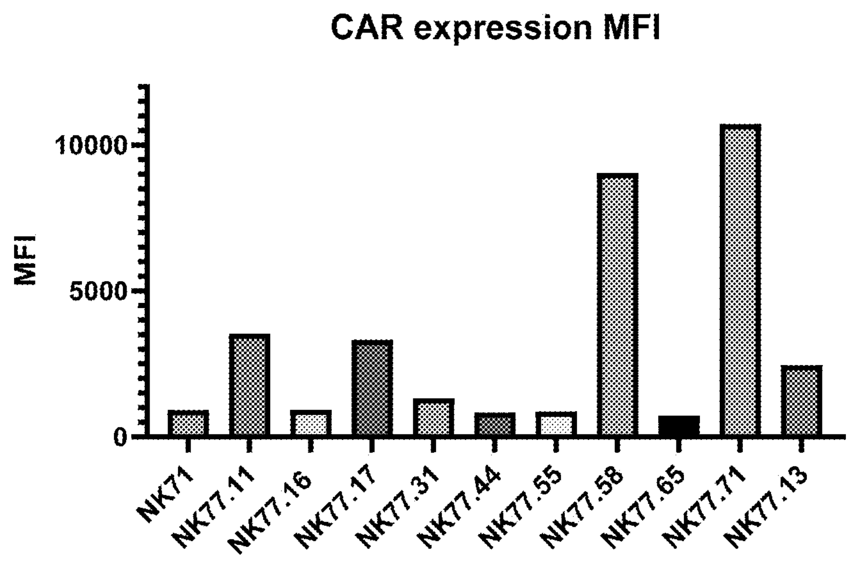
Figure 59D:
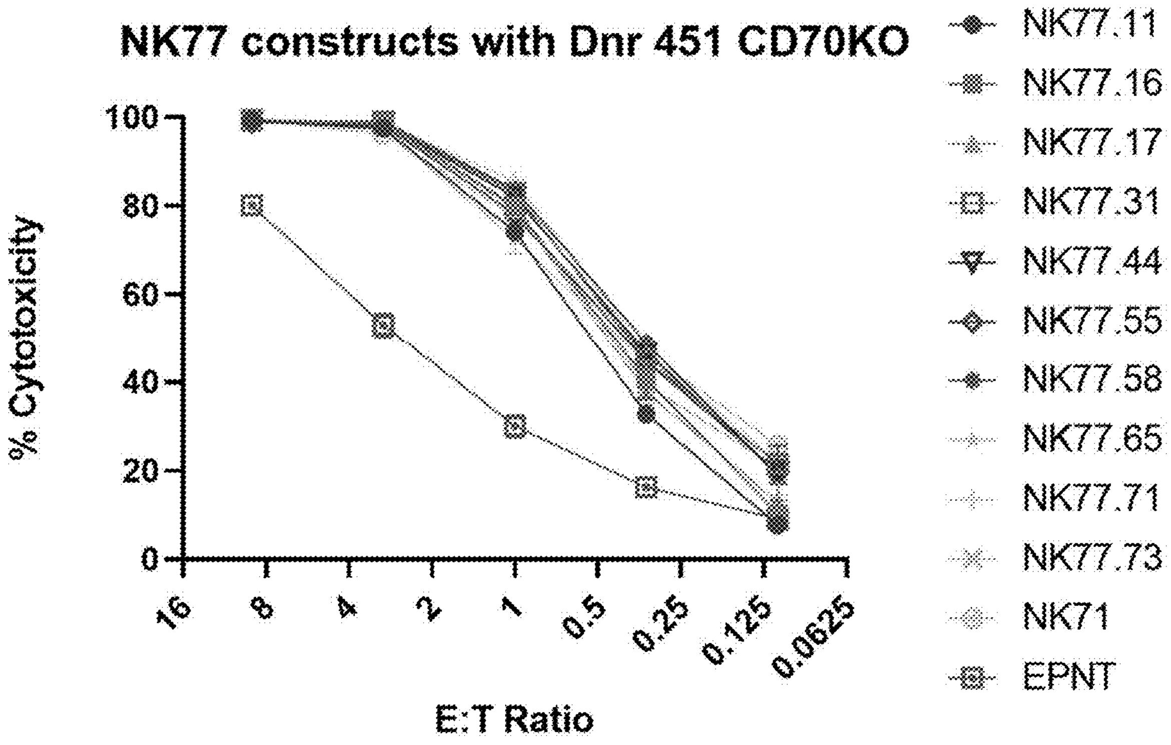

FIGS. 59A-59D shows expression level and preliminary cytotoxicity data for additional anti-CD70 CARs in NK cells gene edited to knockout CD70 in one donor. FIG. 59A shows flow cytometry plots detecting expression of the CAR (by APC anti-FLAG) and loss of expression of CD70 (by PE anti-CD70). FIG. 59B shows the quantification of anti-CD70 CAR and CD70 expression in the NK cell populations of FIG. 59A. FIG. 59C shows the MFI used to quantify CAR expression. FIG. 59D shows a cytotoxicity assay for anti-CD70 CAR NK cell populations against 786-O tumor cells at different effector:target ratios and the calculated $EC_{50}$ from the assay.

Figure 60A:
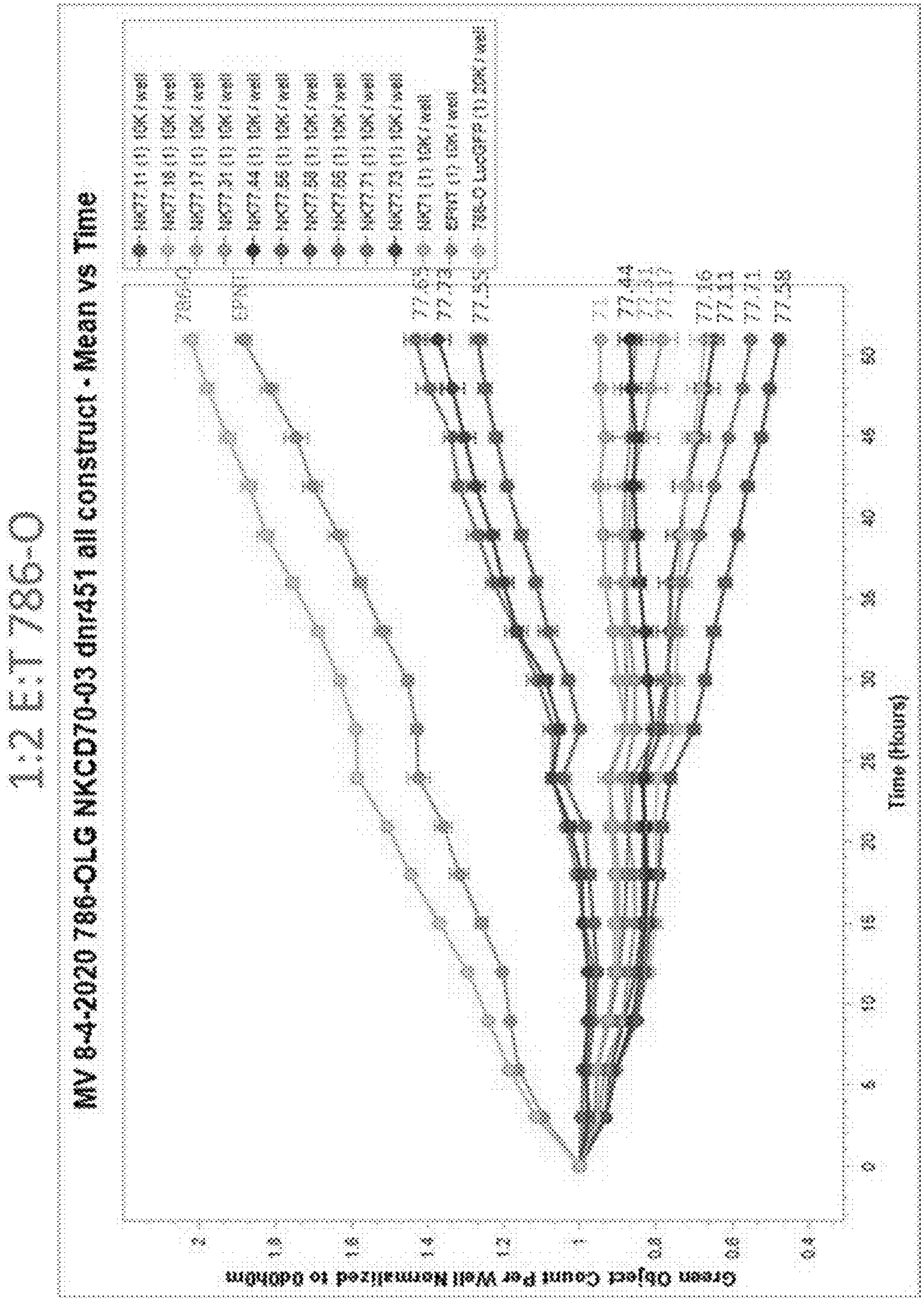
Figure 60B:
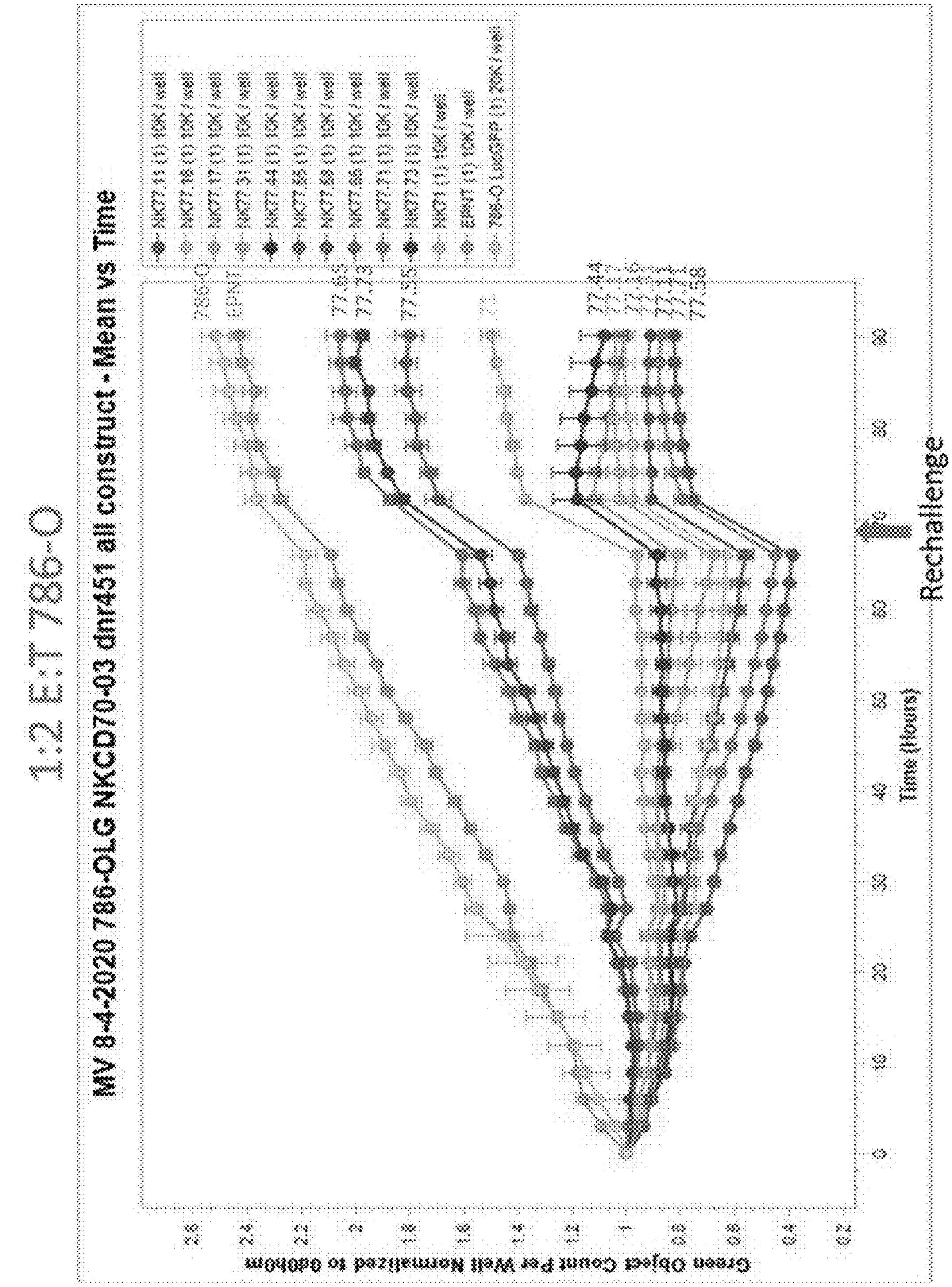
Figure 60C:
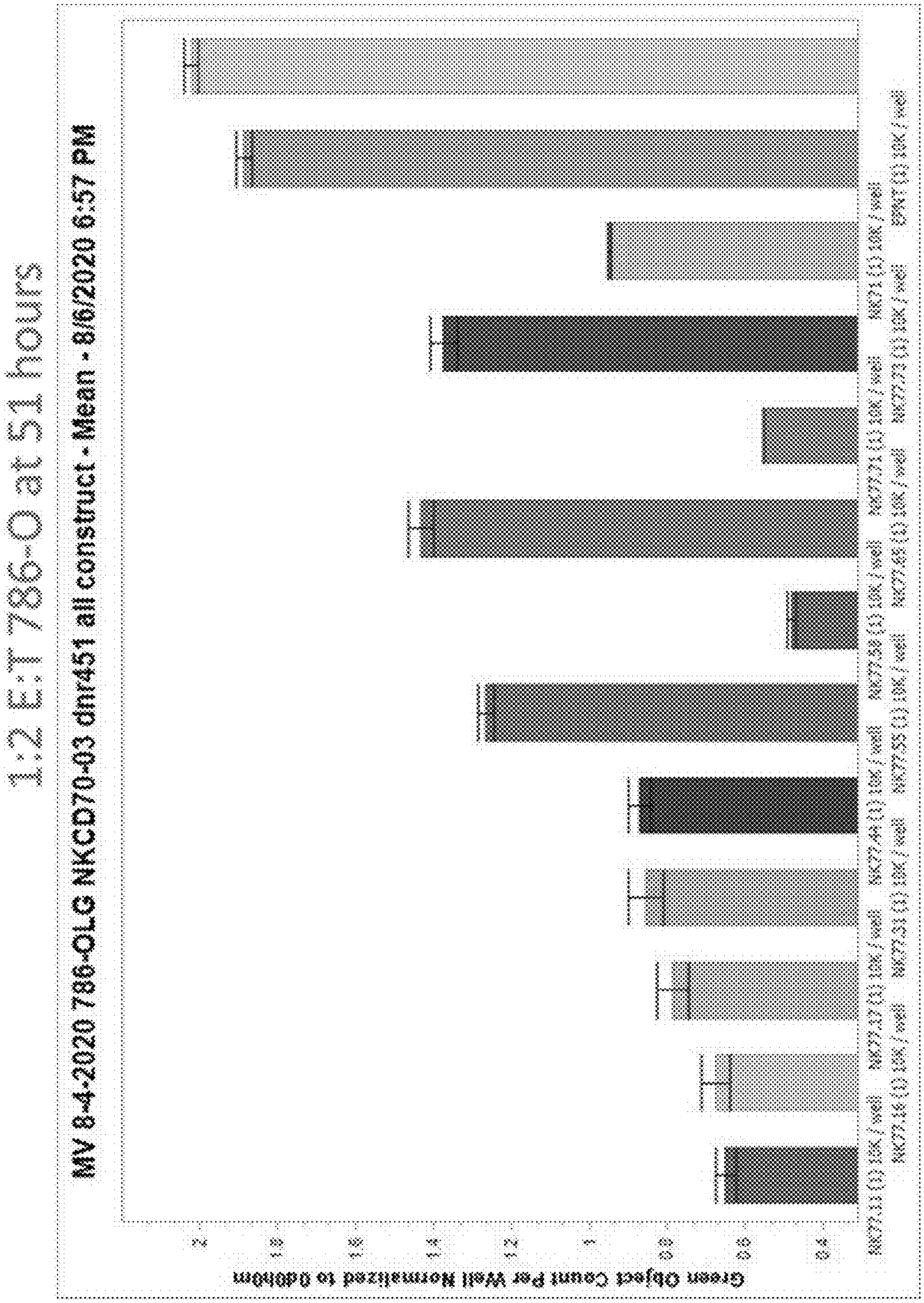
Figure 60D:
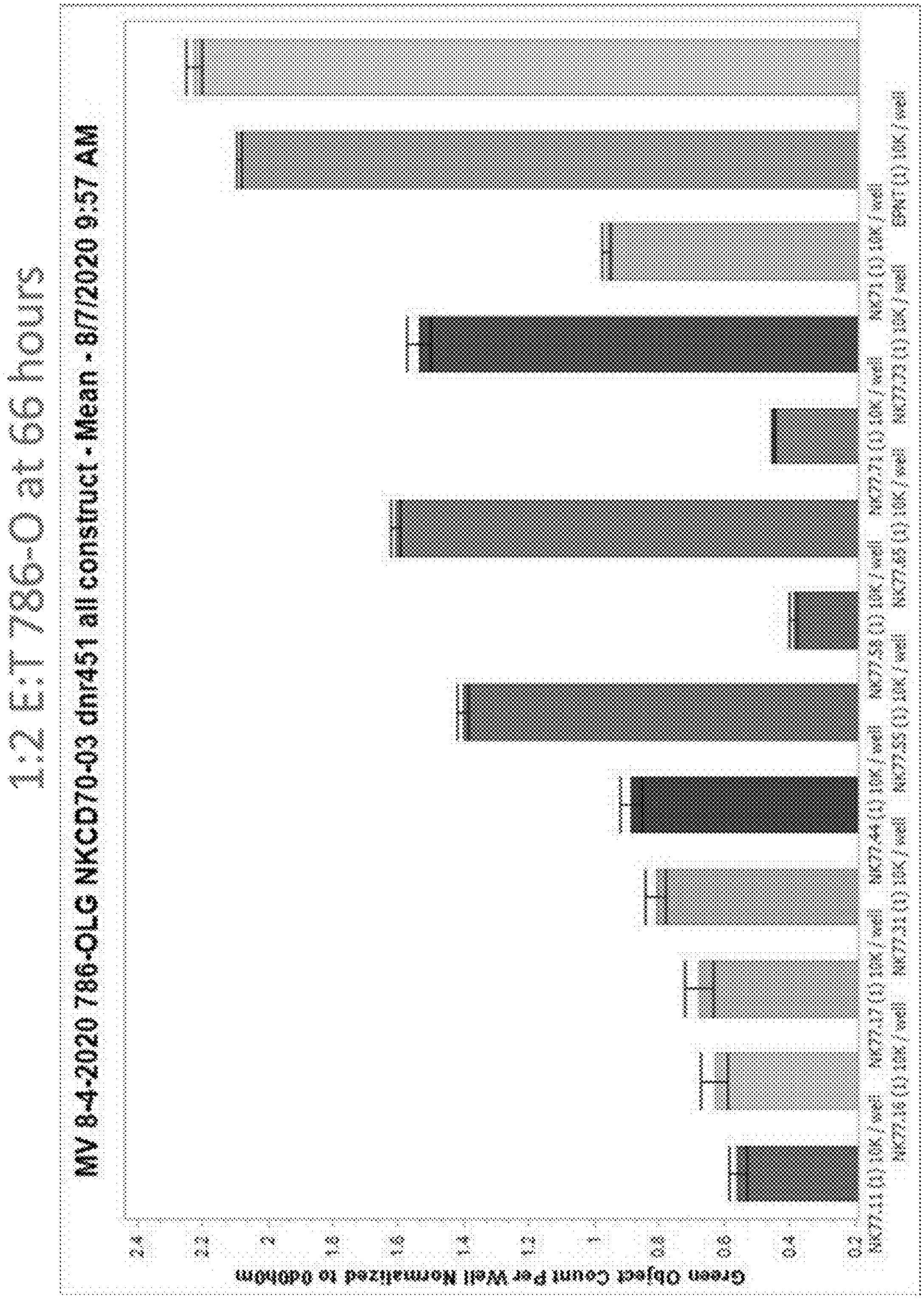
Figure 60E:
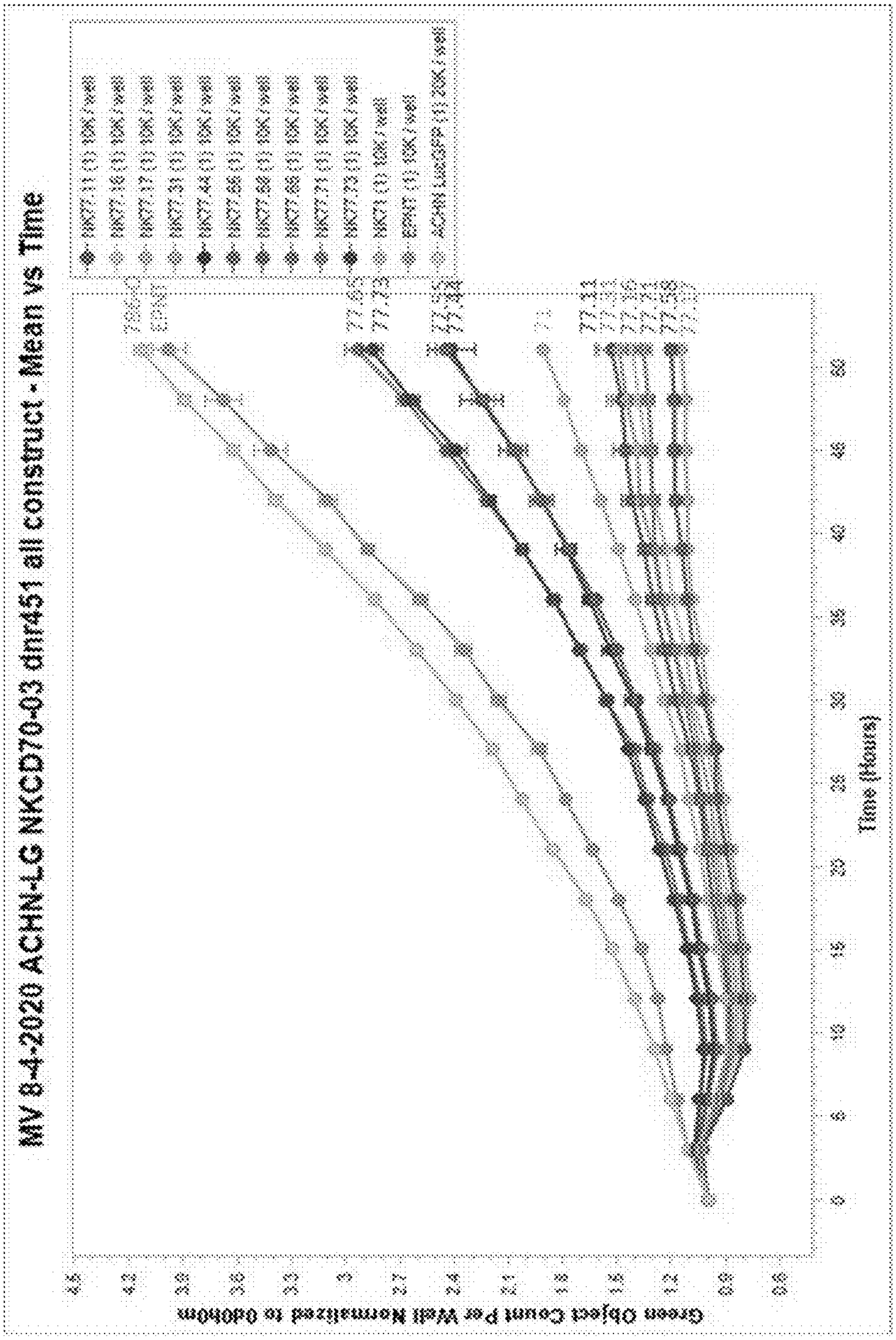
Figure 60F:
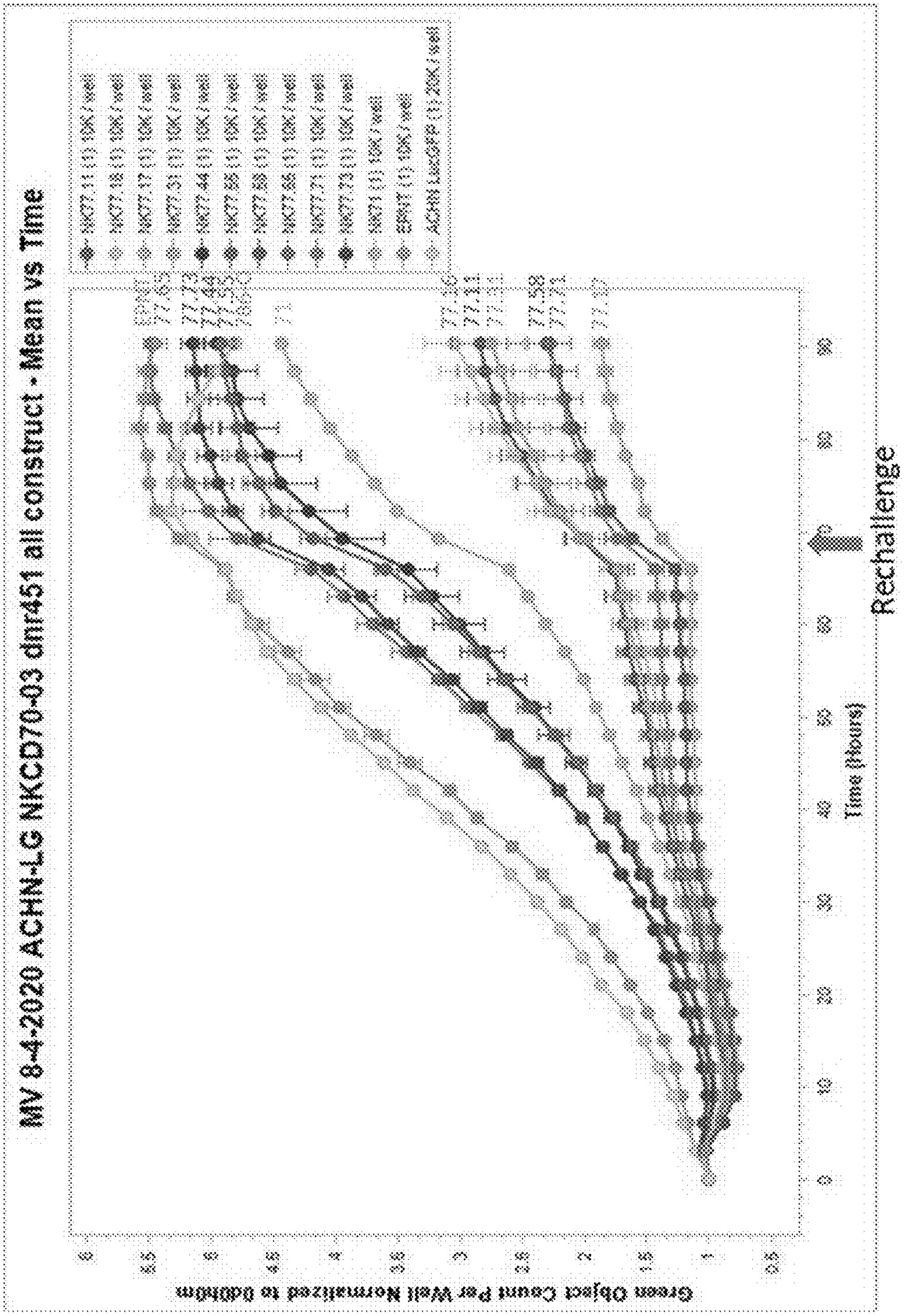
Figure 60G:
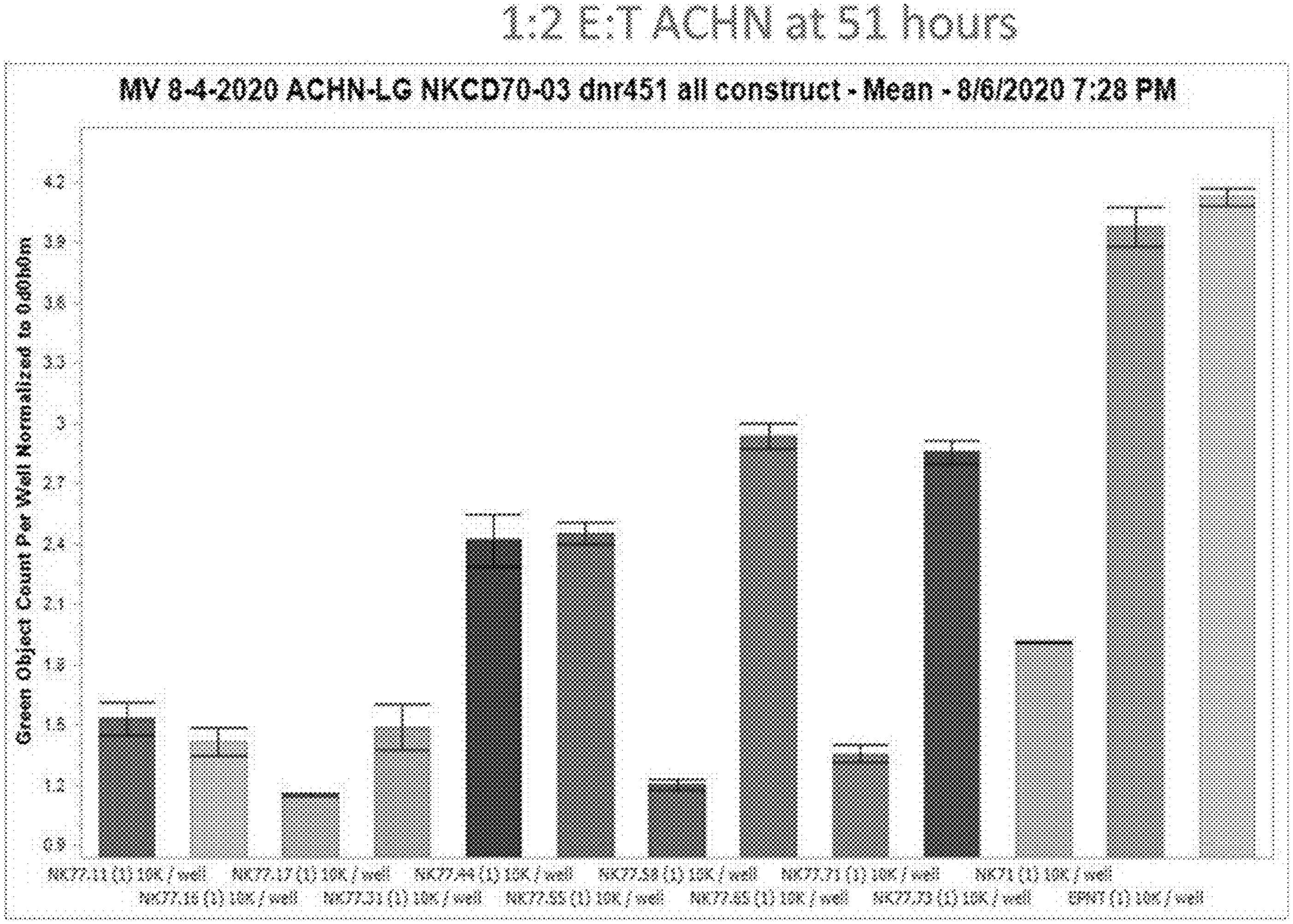
Figure 60H:
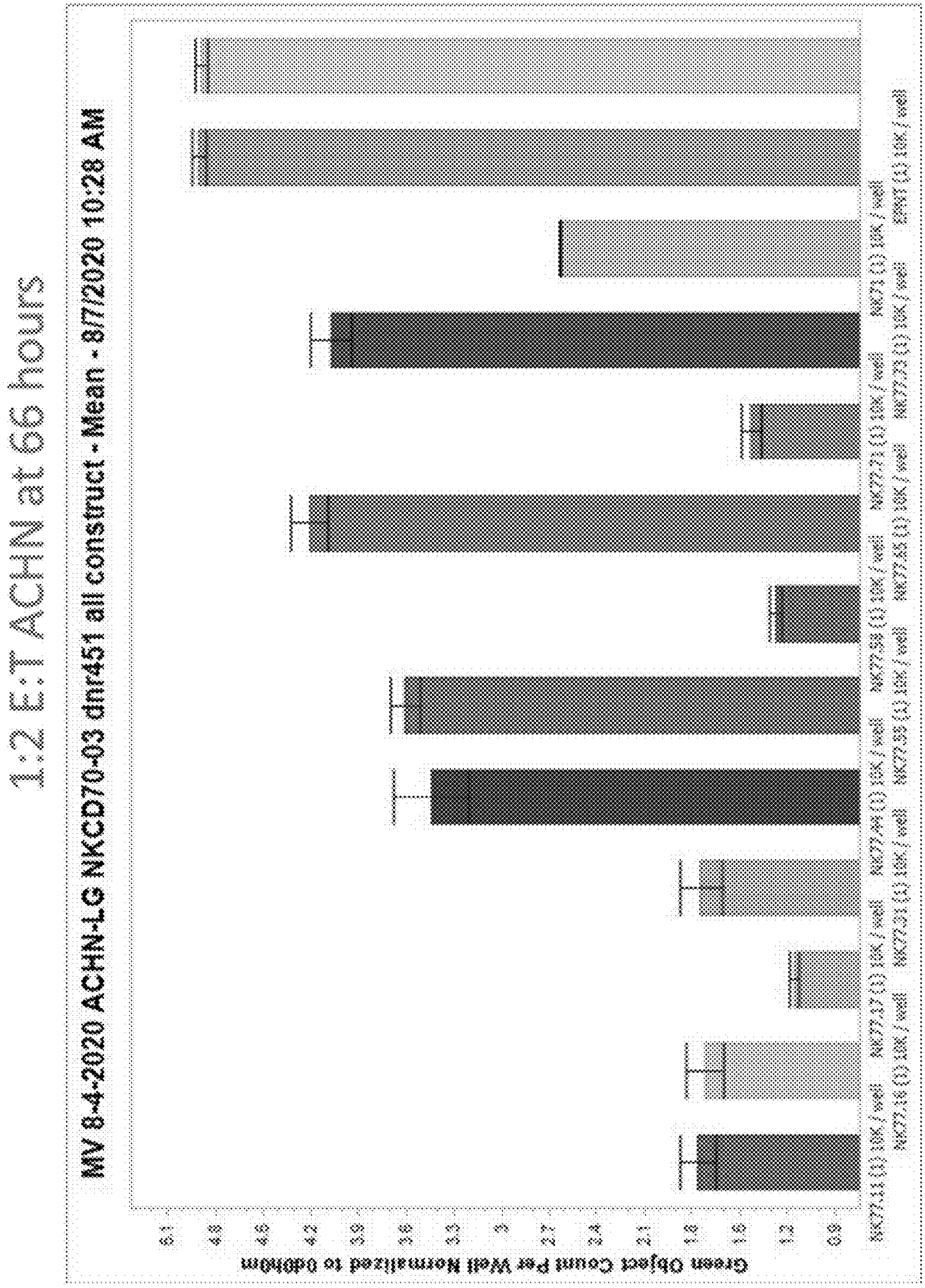
Figure 60I:
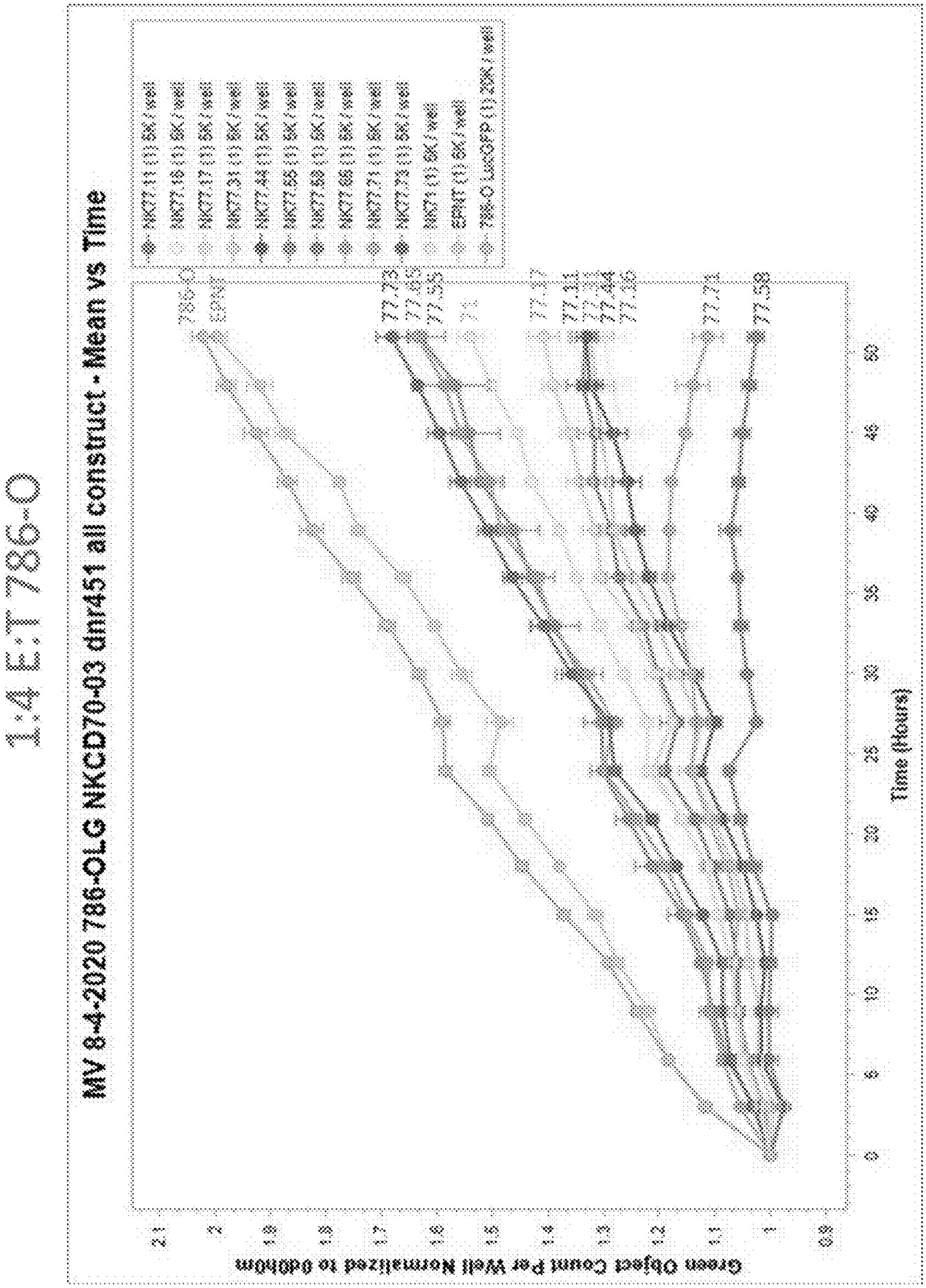
Figure 60J:
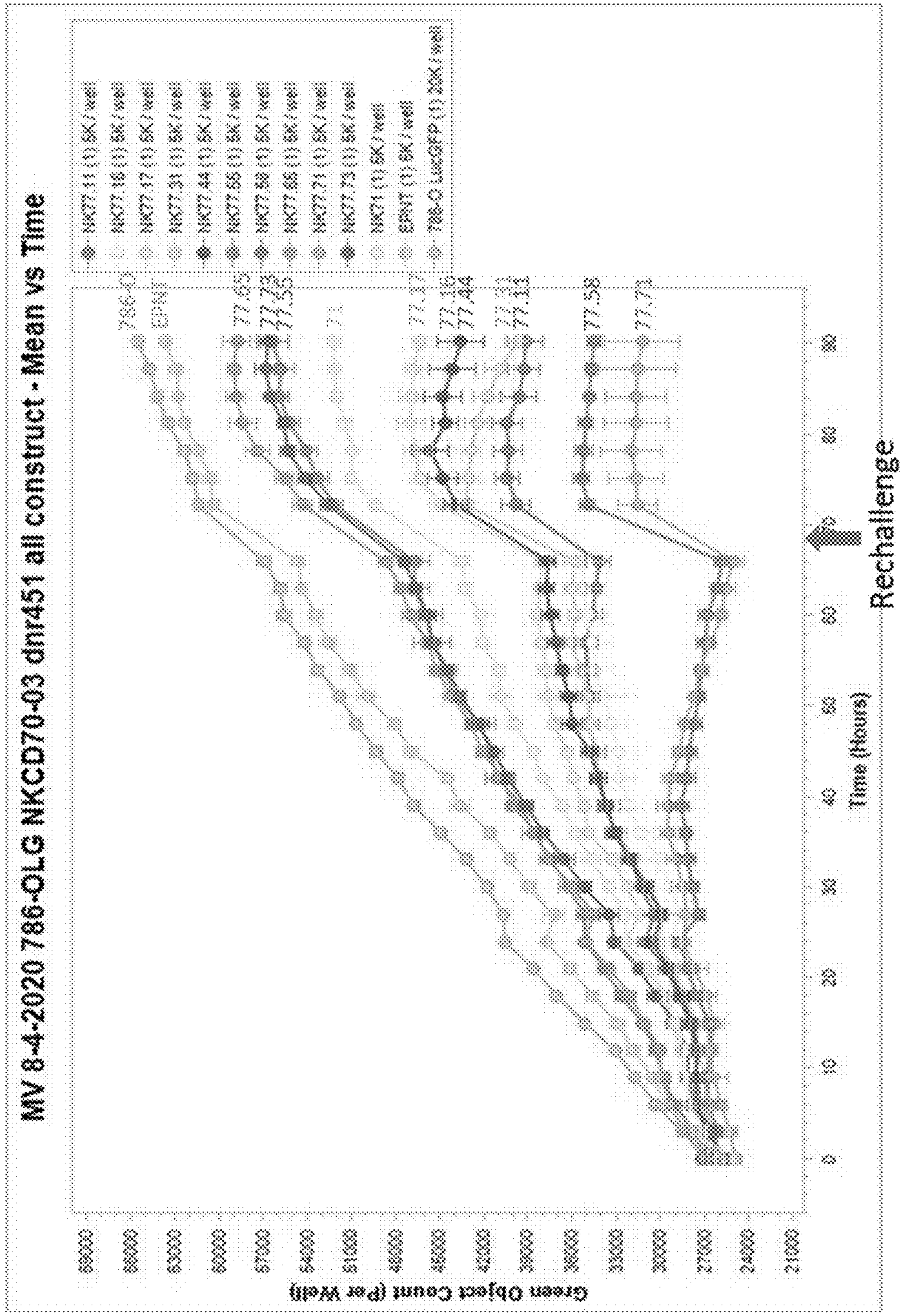
Figure 60K:
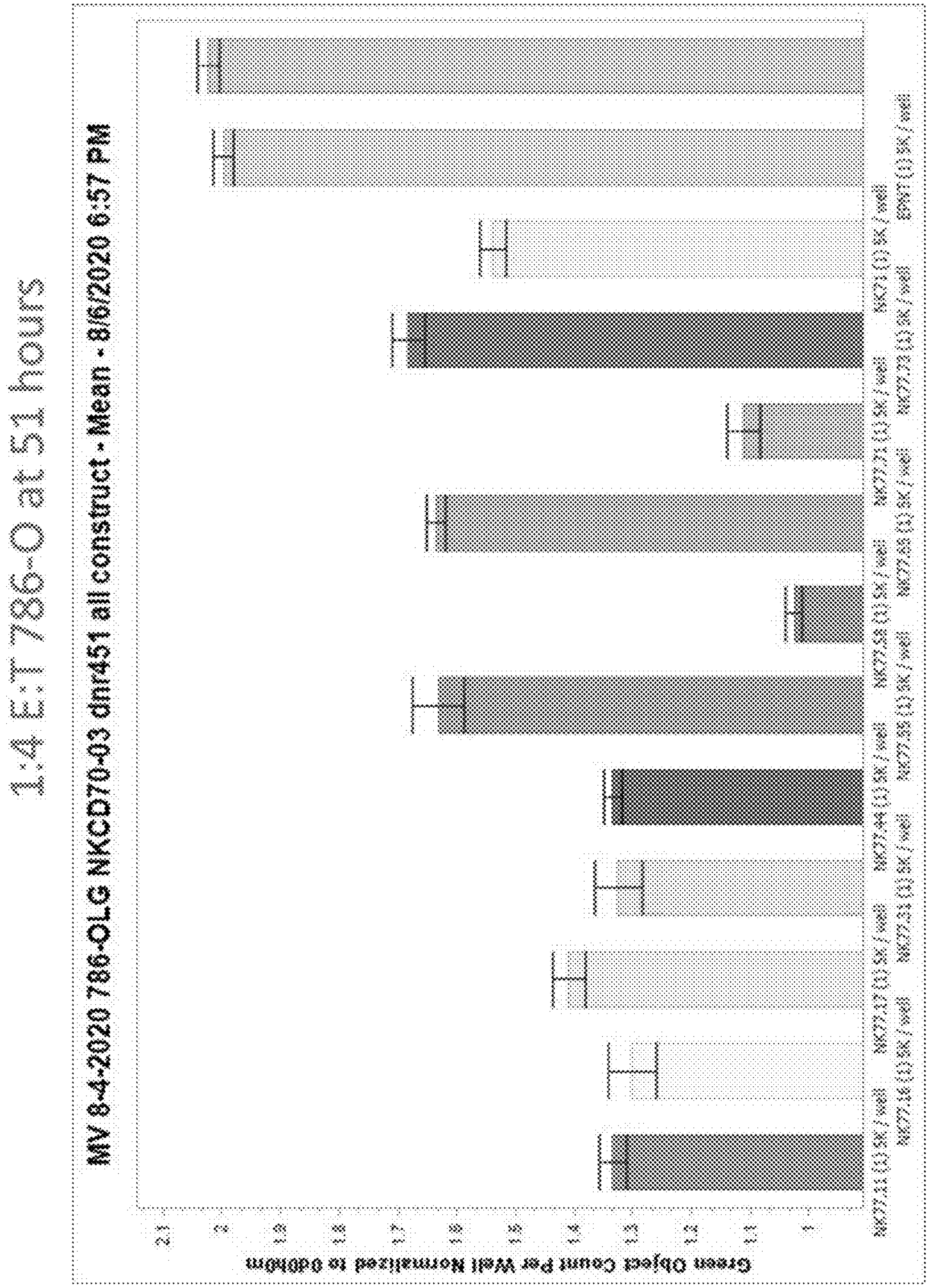
Figure 60L:
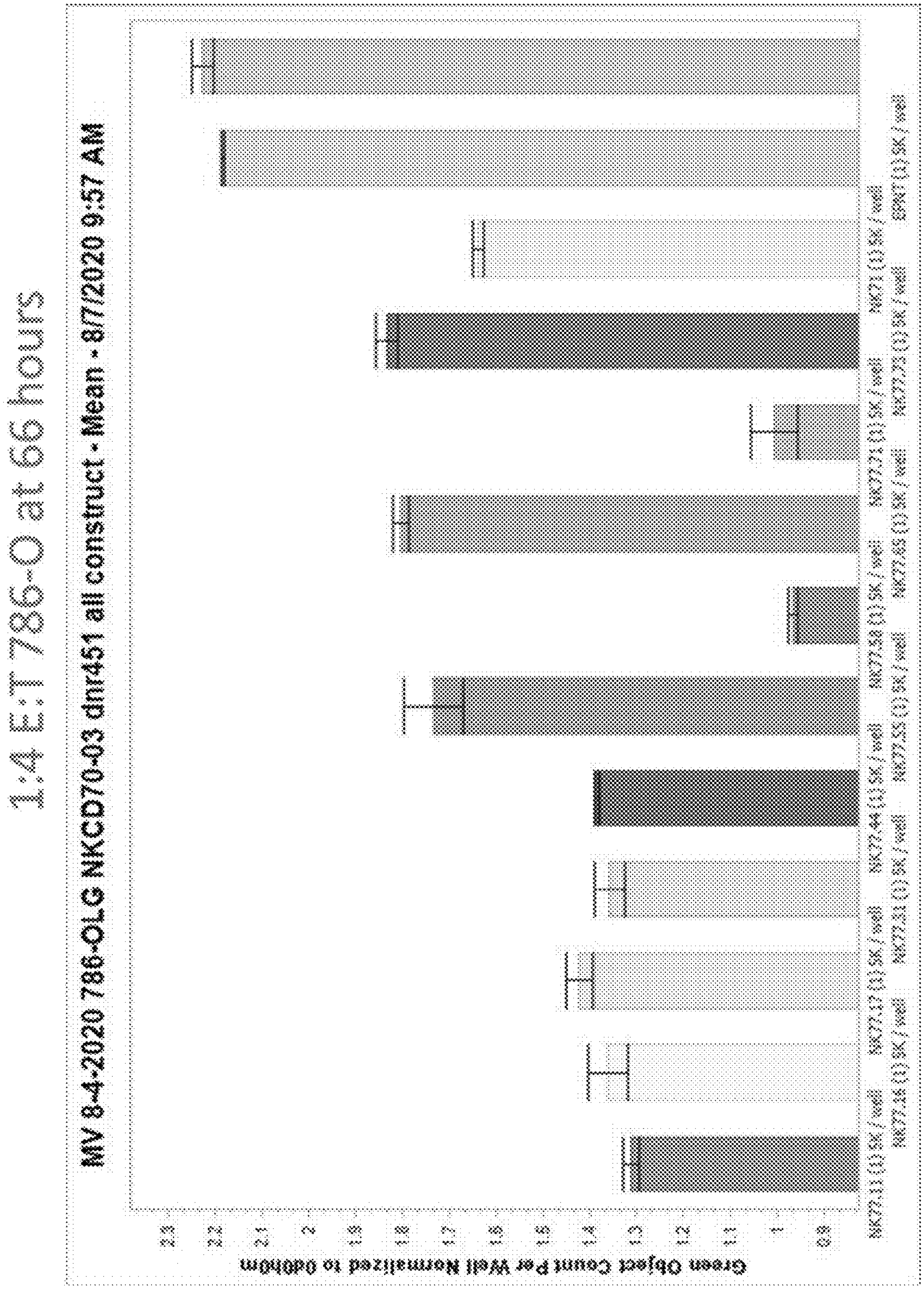
Figure 60M:
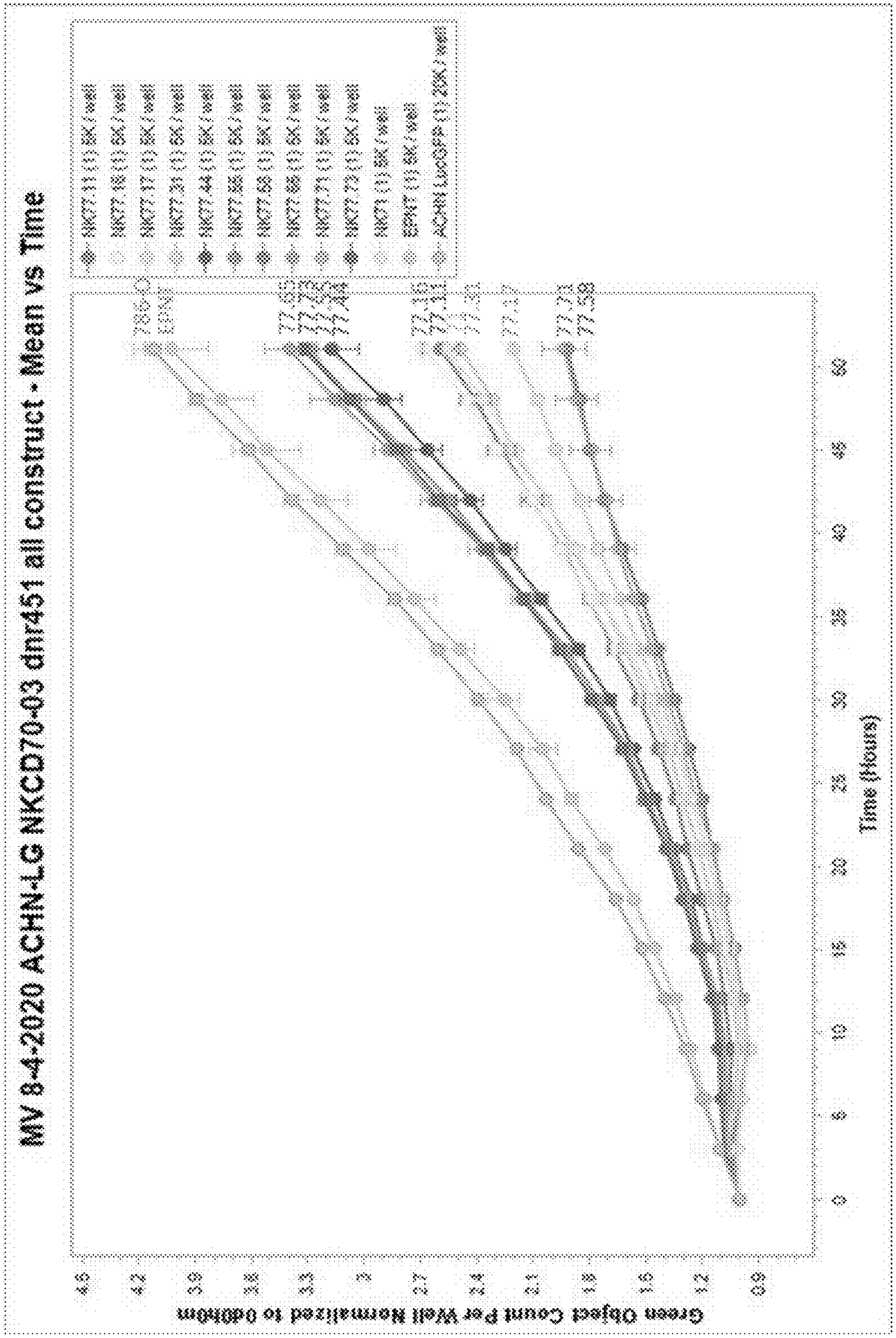
Figure 60N:
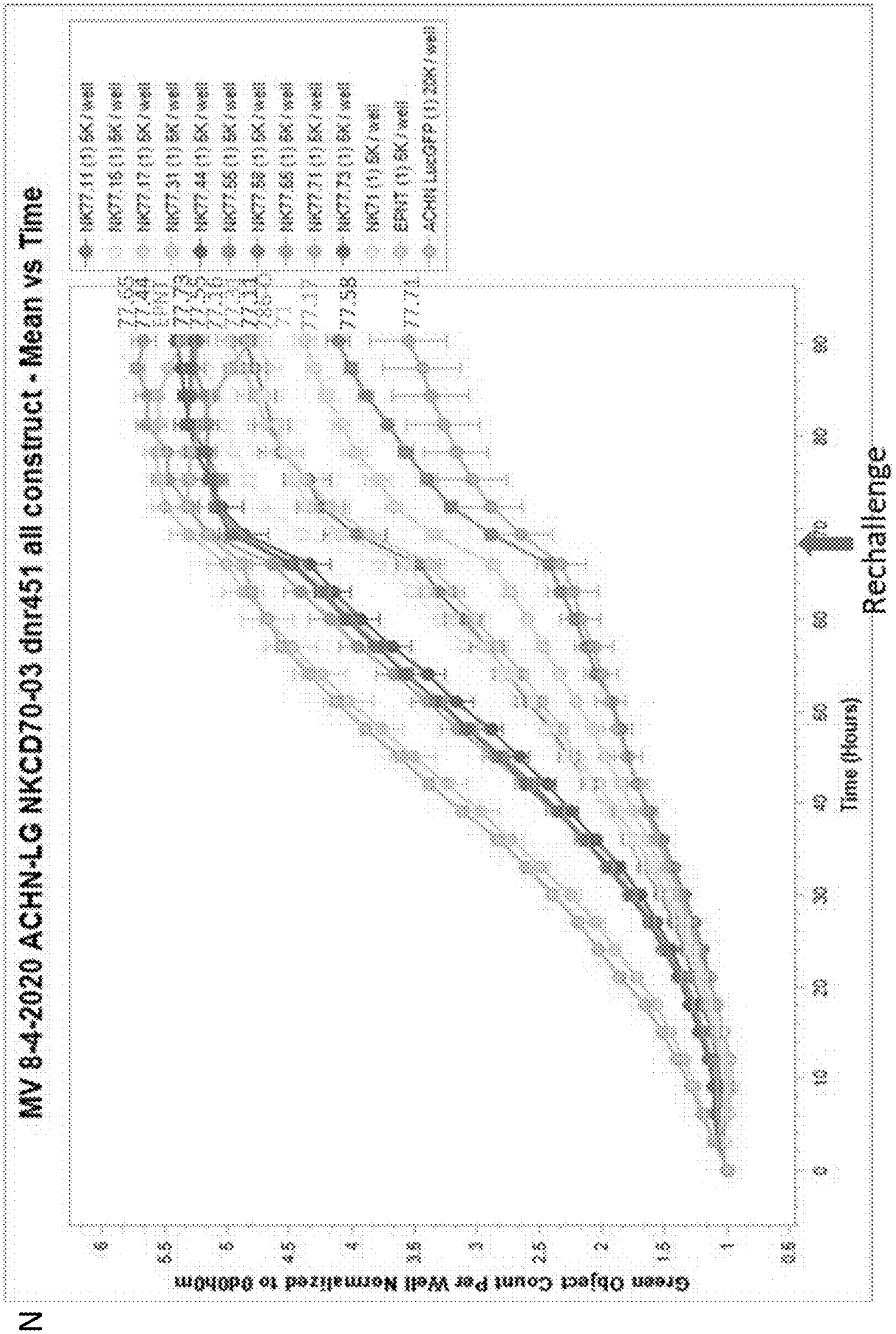
Figure 600:
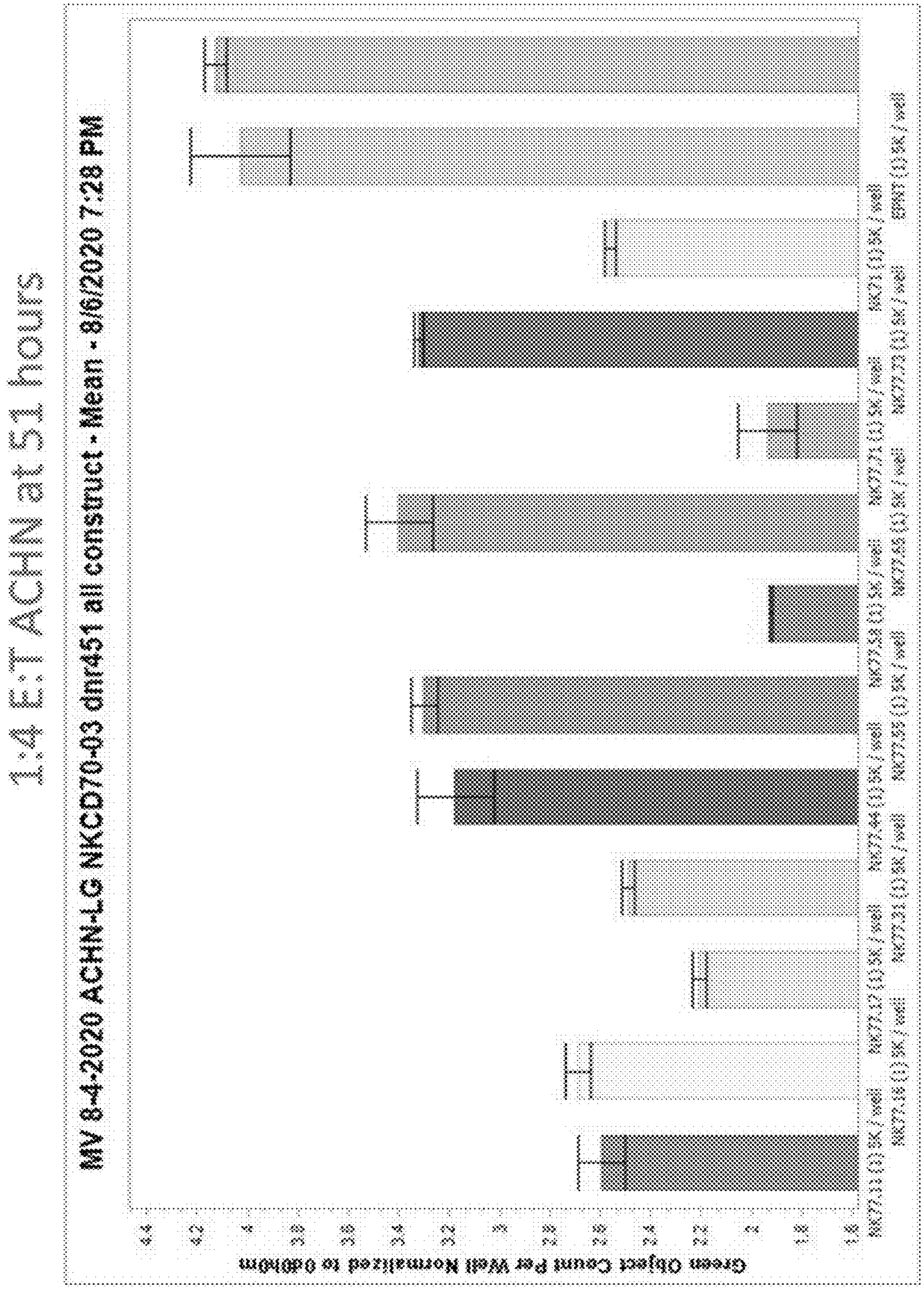
Figure 60P:
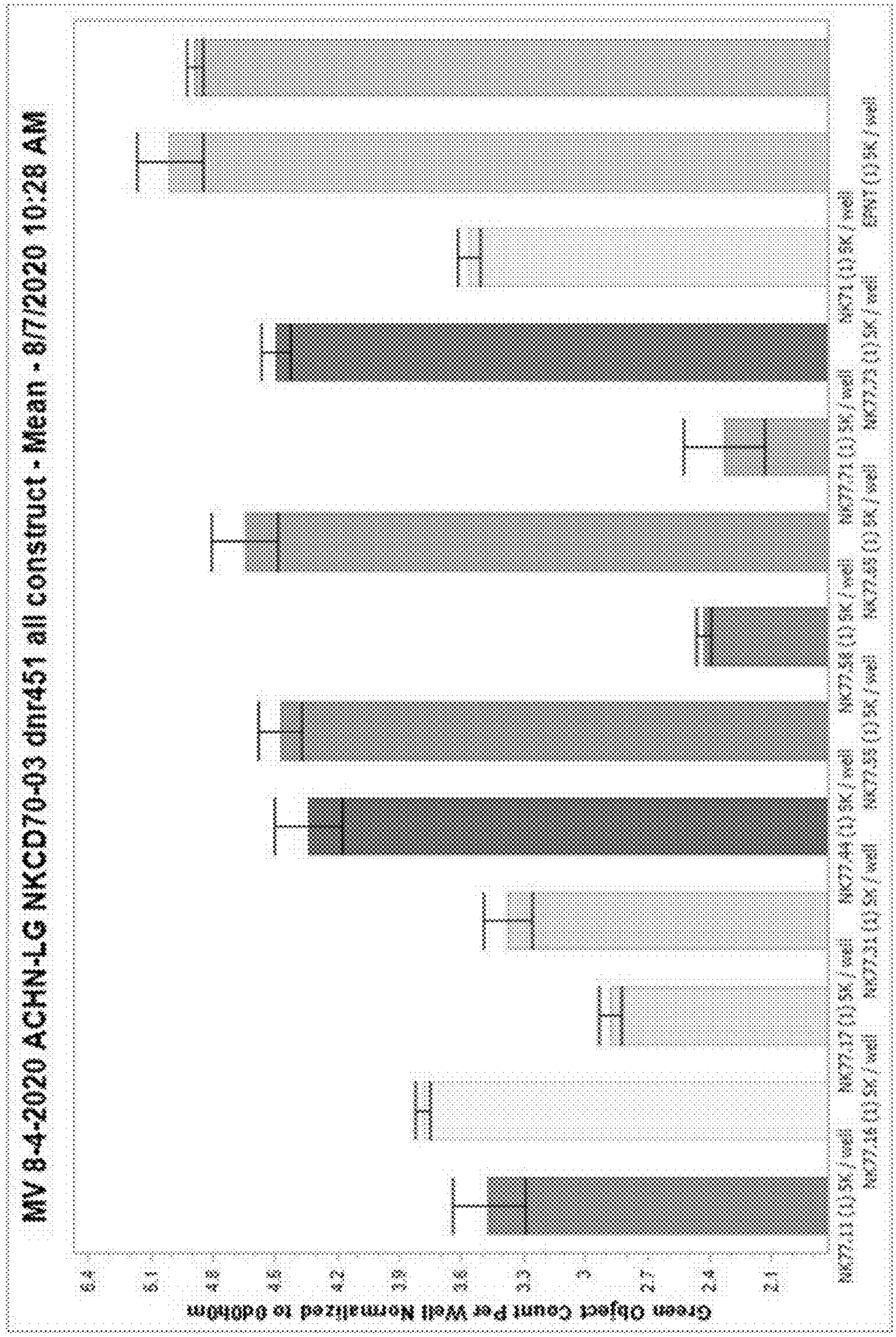

FIGS. 60A-60O shows cytotoxicity data of tested anti-CD70 CARs in CD70 knockout NK cells from a donor against either 786-O or ACHN tumor cells. FIG. 60A shows cytotoxicity data of tested NK cells against 786-O cells at a 1:2 ratio, for up to 51 hours. FIG. 60B shows cytotoxicity data of tested NK cells of FIG. 60A, extended to 90 hours and re-challenged with additional tumor cells at 70 hours. FIG. 60C shows remaining 786-O cells at 51 hours following the NK cell 1:2 co-culture as measured by 786-O fluorescence. FIG. 60D shows remaining 786-O cells at 66 hours following the NK cell 1:2 co-culture as measured by 786-O fluorescence. FIG. 60E shows cytotoxicity data of tested NK cells against ACHN cells at a 1:2 ratio, for up to 51 hours. FIG. 60F shows cytotoxicity data of tested NK cells of FIG. 60E extended to 90 hours and re-challenged with additional tumor cells at 70 hours. FIG. 60G shows remaining ACHN cells at 51 hours following the NK cell 1:2 co-culture as measured by ACHN fluorescence. FIG. 60H shows remaining ACHN cells at 66 hours following the NK cell 1:2 co-culture as measured by ACHN fluorescence. FIG. 60I shows cytotoxicity data of tested NK cells against 786-O cells at a ratio of 1:4, for up to 51 hours. FIG. 60J shows cytotoxicity data of the tested NK cell cultures of FIG. 60I, but extended to 90 hours and re-challenged with additional tumor cells at 70 hours. FIG. 60K shows remaining 786-O cells at 51 hours following the NK cell 1:4 co-culture as measured by 786-O fluorescence. FIG. 60L shows remaining 786-O cells at 66 hours following the NK cell 1:4 co-culture as measured by 786-O fluorescence. FIG. 60M shows cytotoxicity data of tested NK cells against ACHN cells at a 1:4 ratio, for up to 51 hours. FIG. 60N shows cytotoxicity data of the tested NK cell cultures of FIG. 60M, but extended to 90 hours and re-challenged with additional tumor cells at 70 hours. FIG. 60O shows remaining ACHN cells at 51 hours following the NK cell 1:4 co-culture as measured by ACHN fluorescence. FIG. 60P shows remaining ACHN cells at 66 hours following the NK cell 1:4 co-culture as measured by ACHN fluorescence.

Figure 61A:
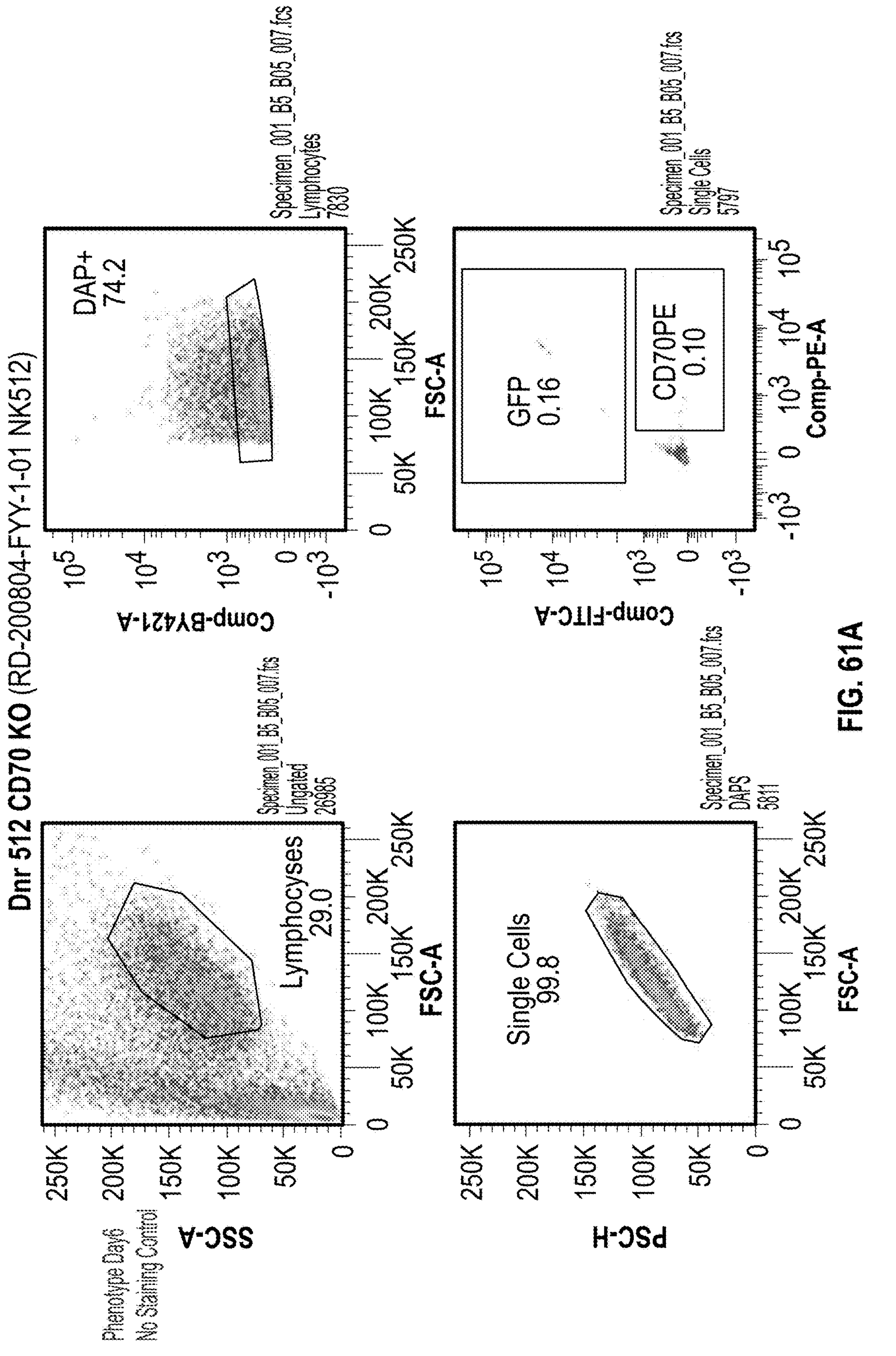
Figure 61A:
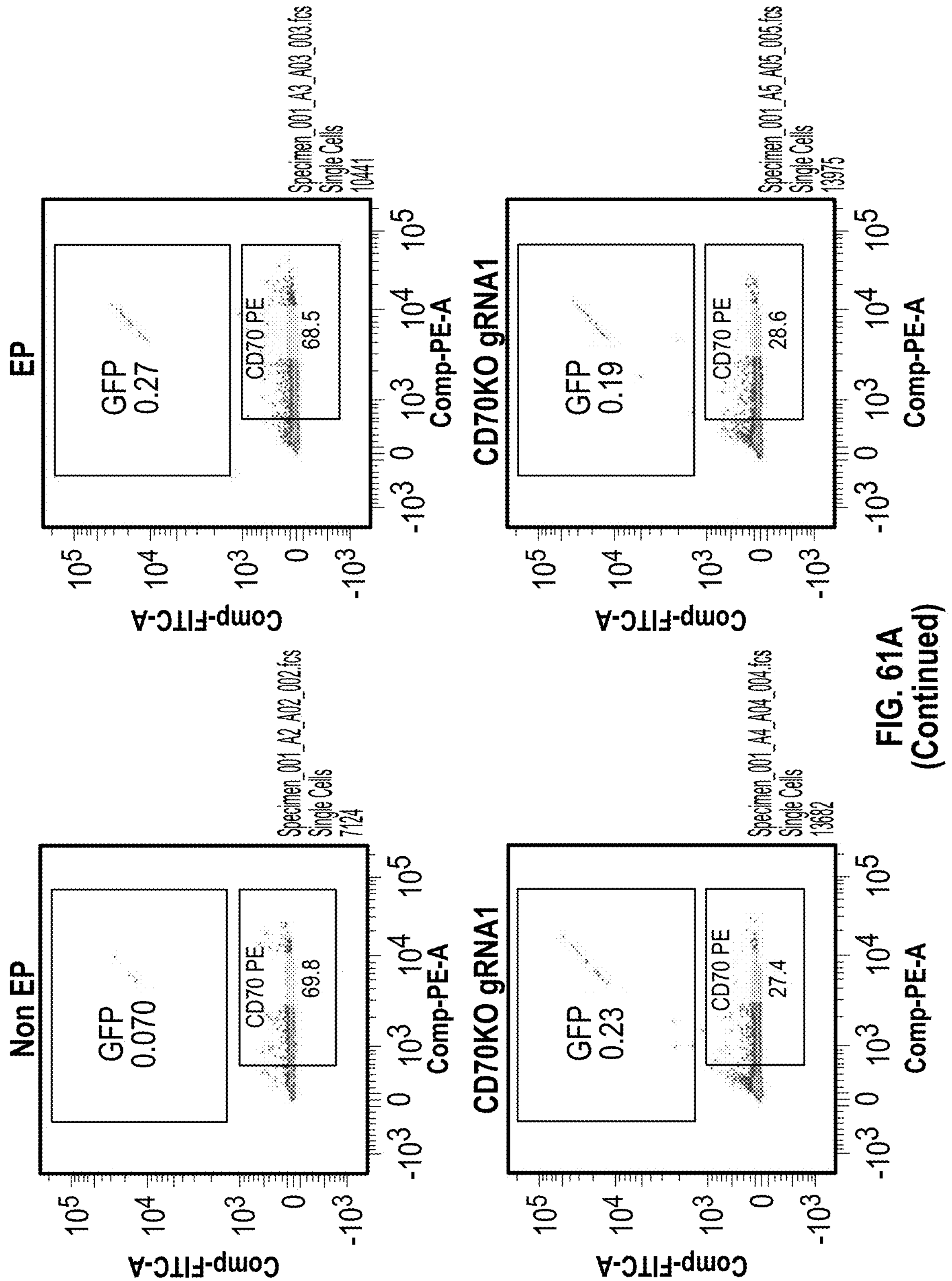
Figure 61B:
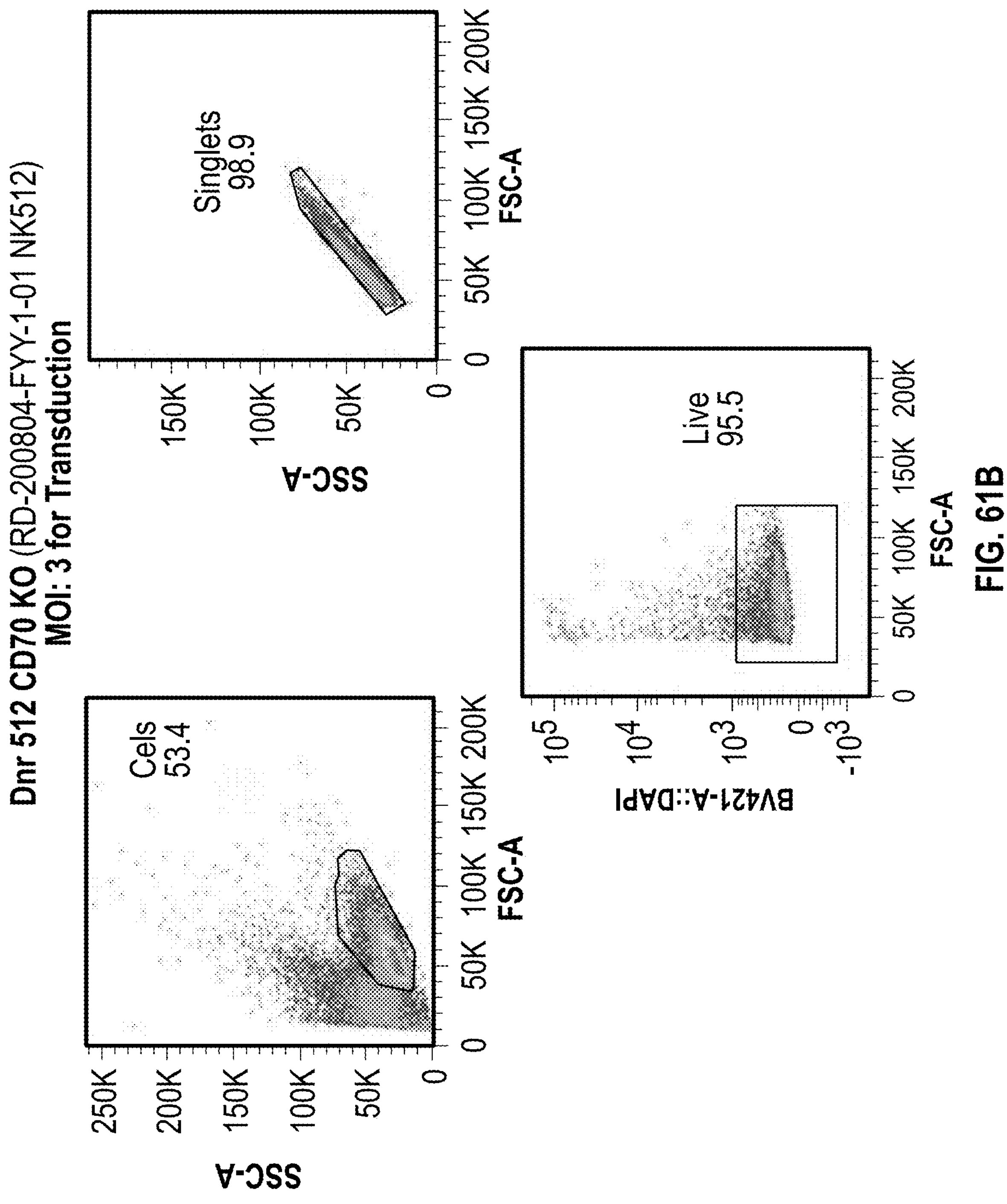
Figure 61B:
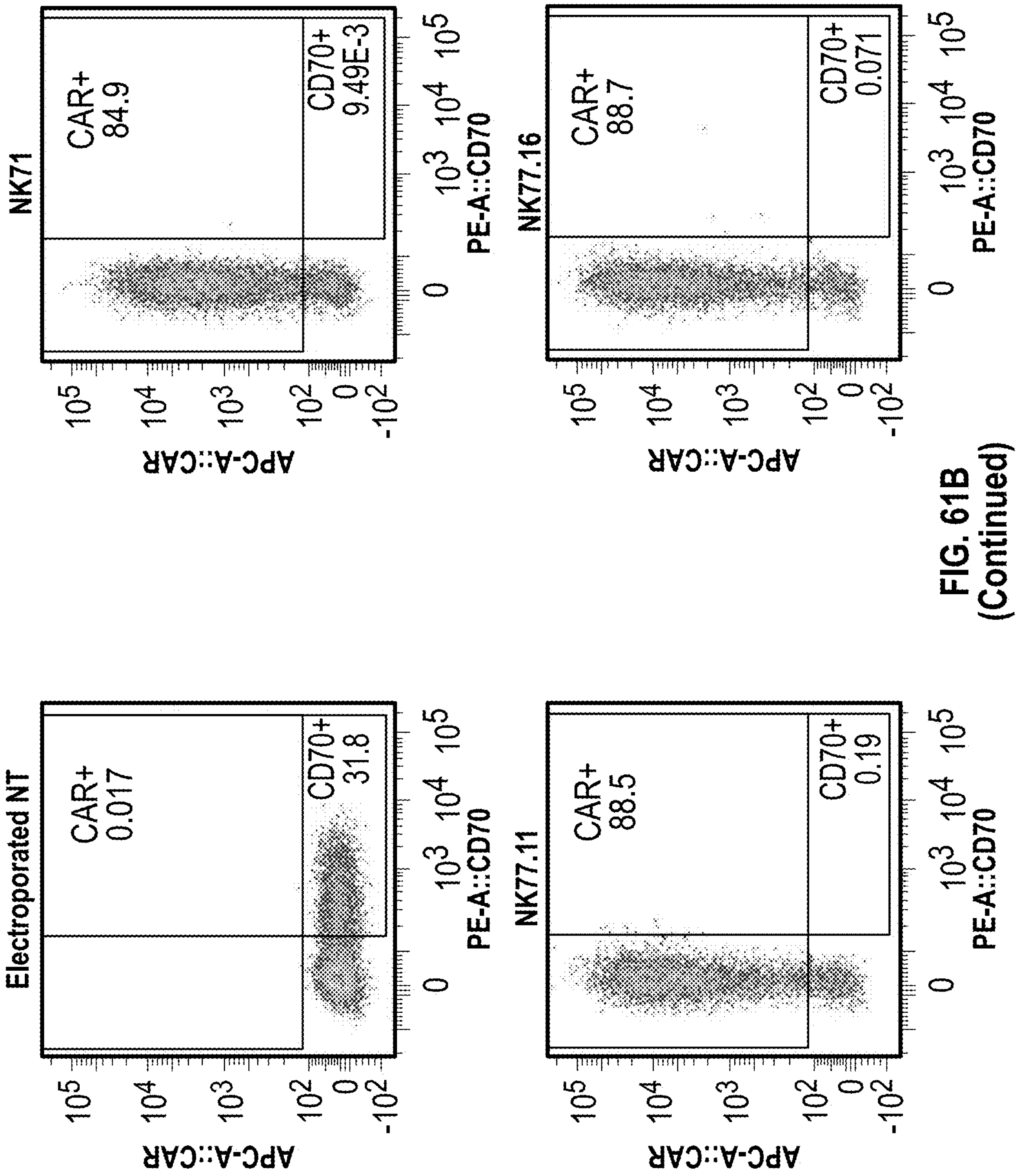
Figure 61B:
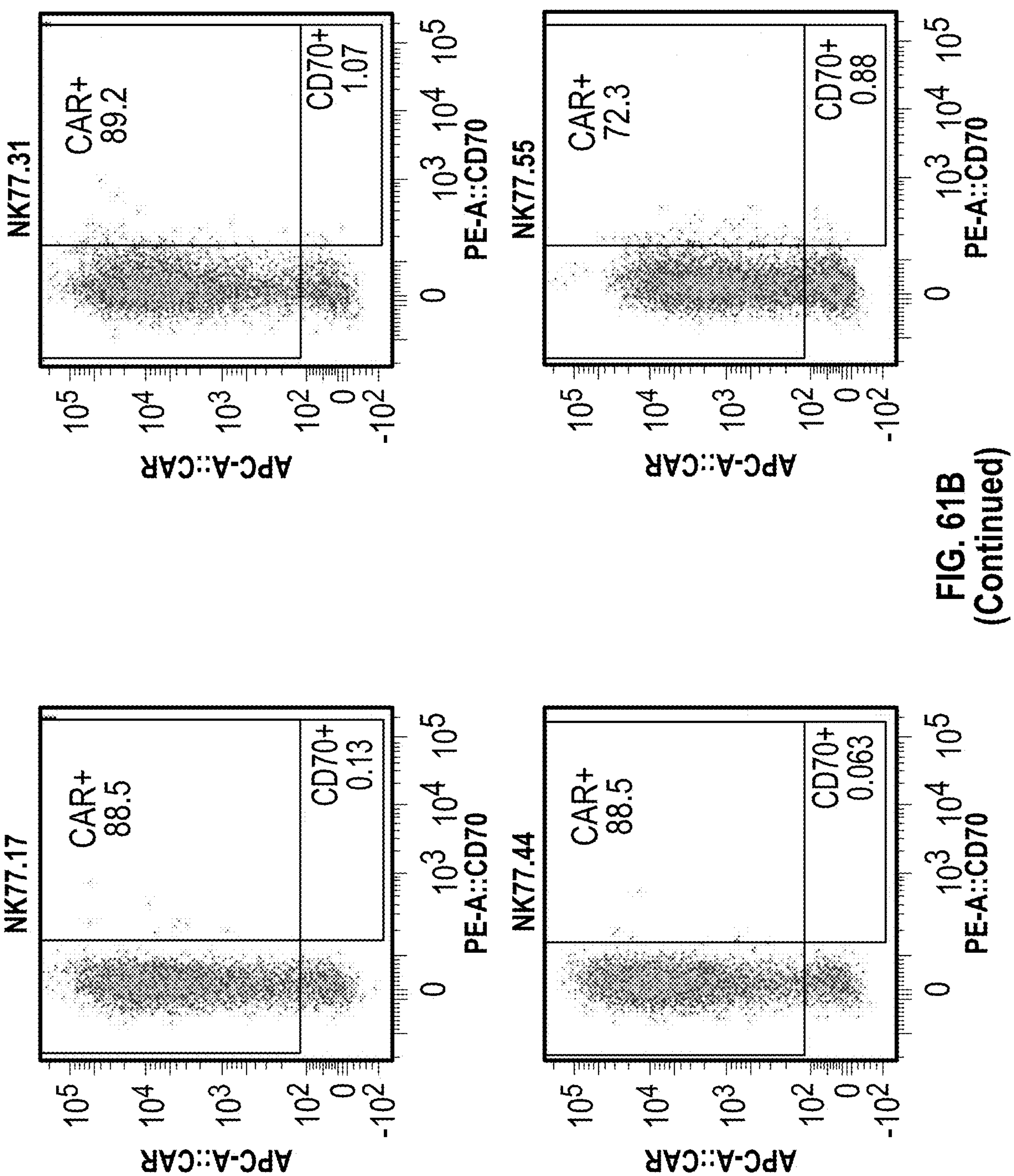
Figure 61B:
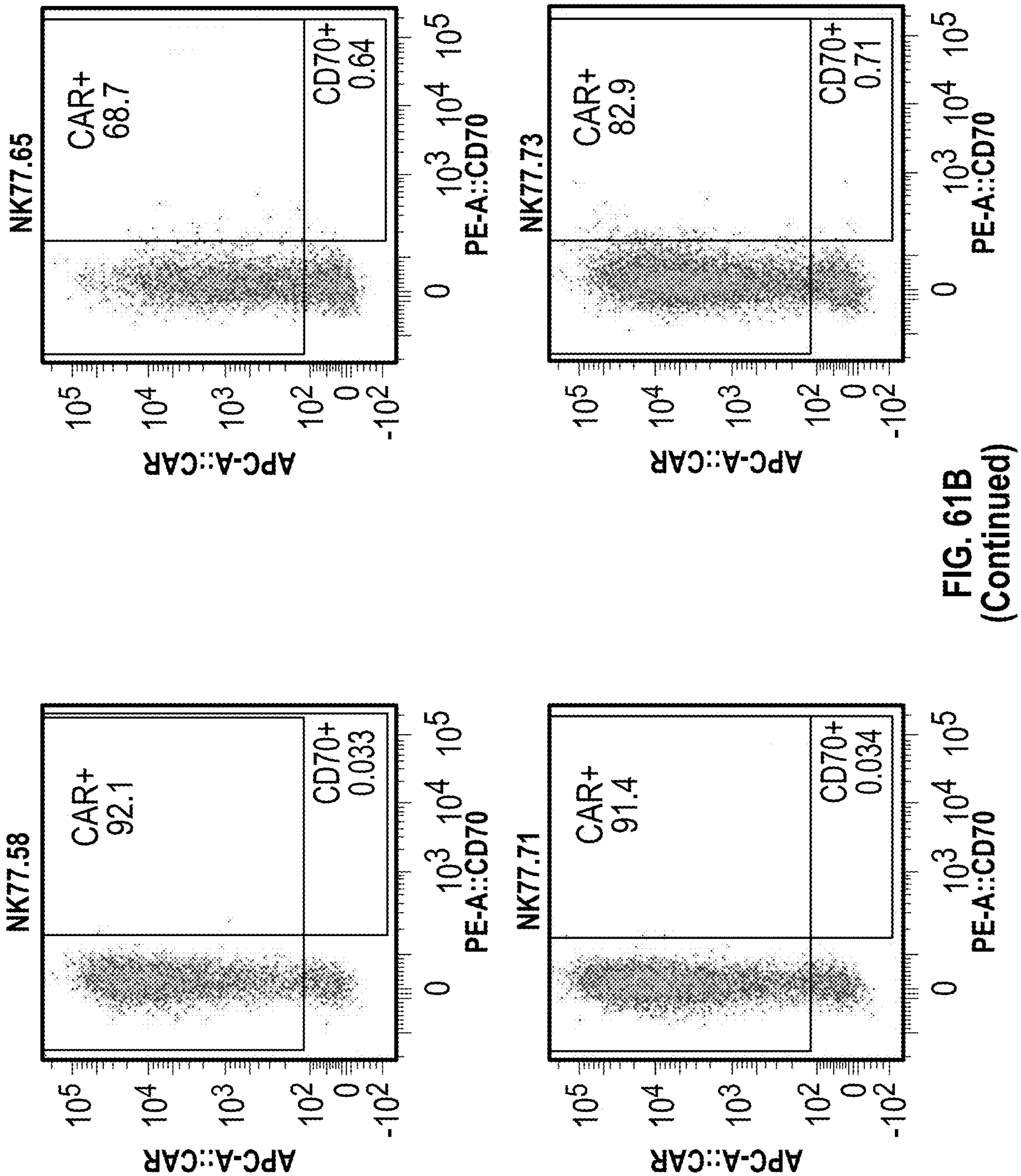
Figures 61C, 61D:
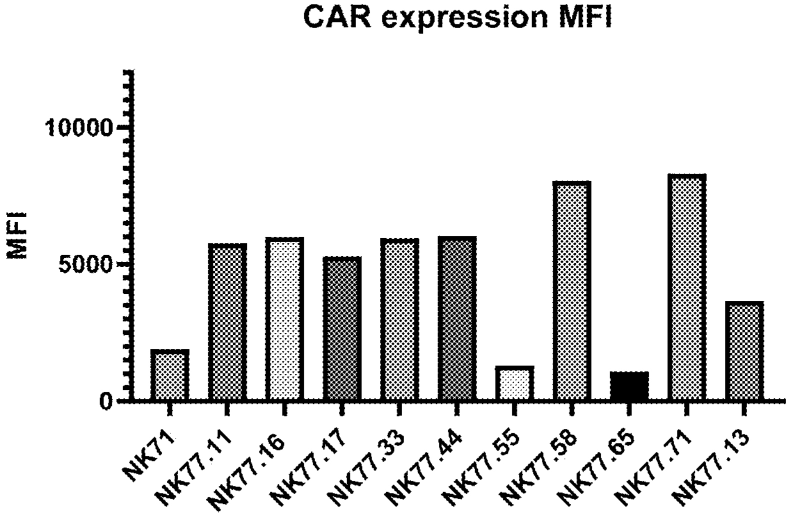
Figure 61F:
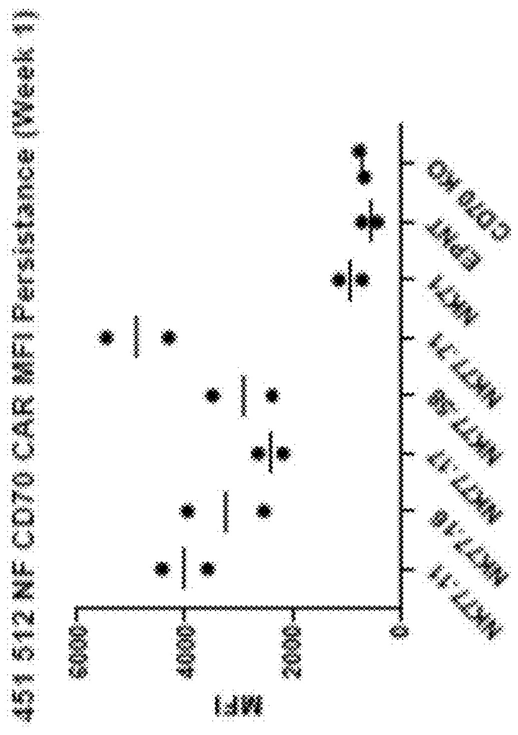
Figure 61E:
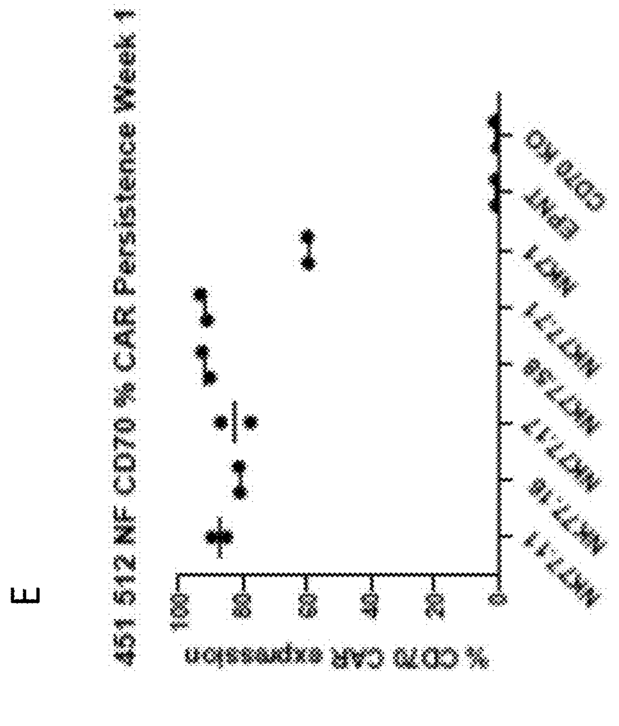
Figure 61H:
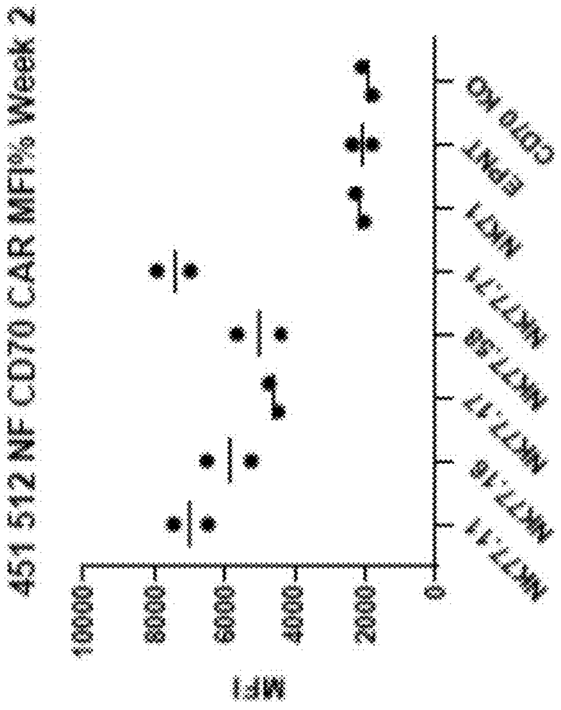
Figure 61G:
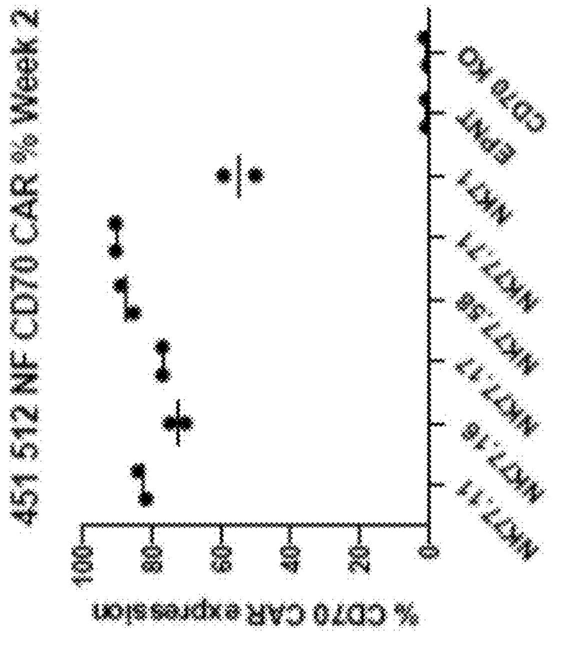
Figure 61I:
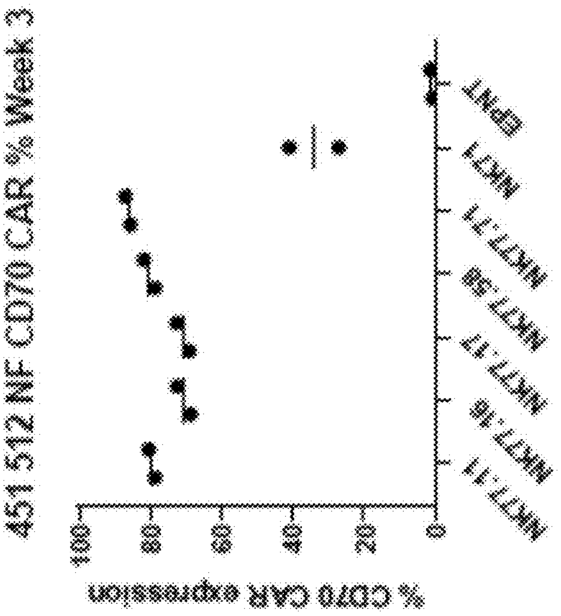
Figure 61J:
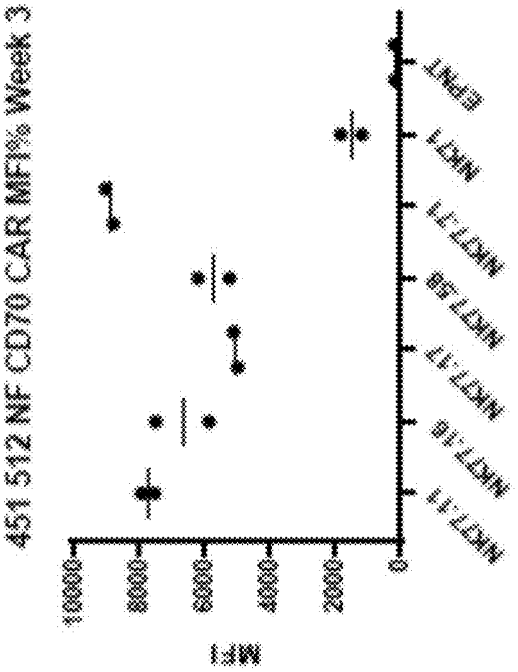
Figure 61K:
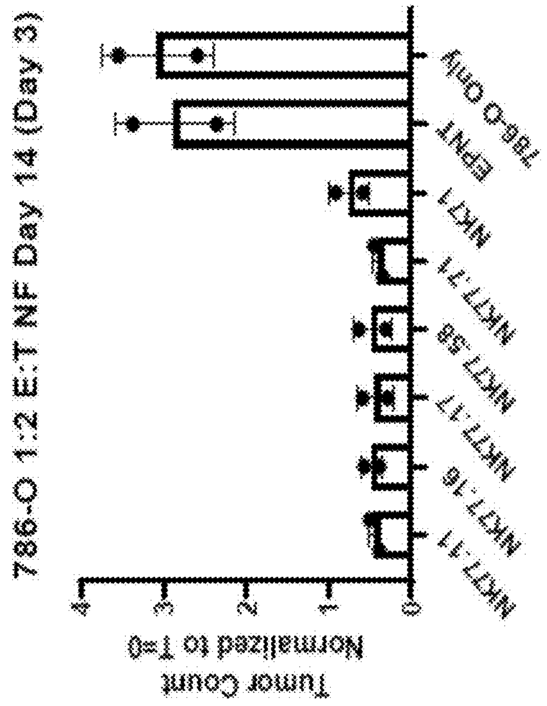
Figure 61L:
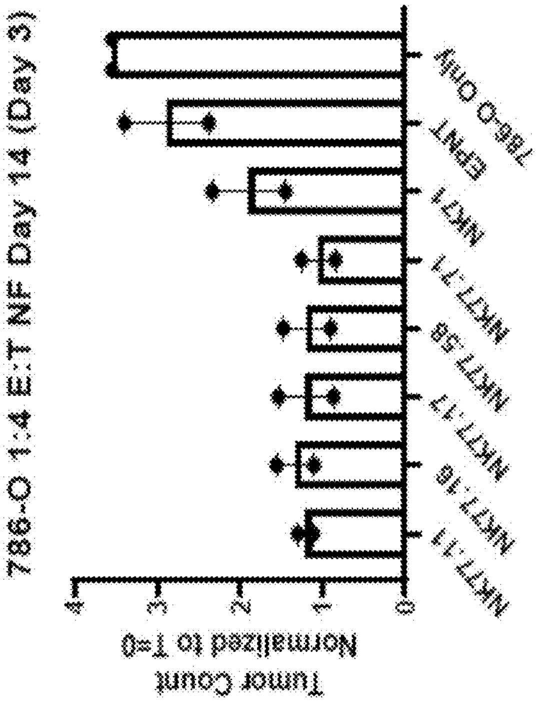
Figure 61M:
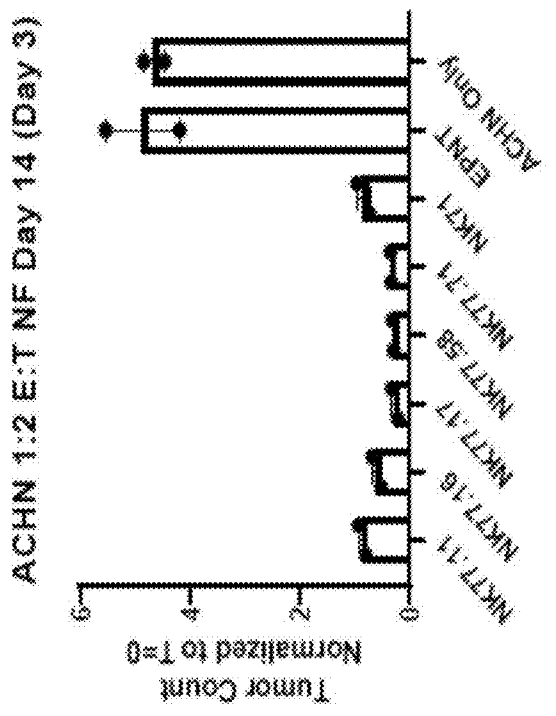
Figure 61N:
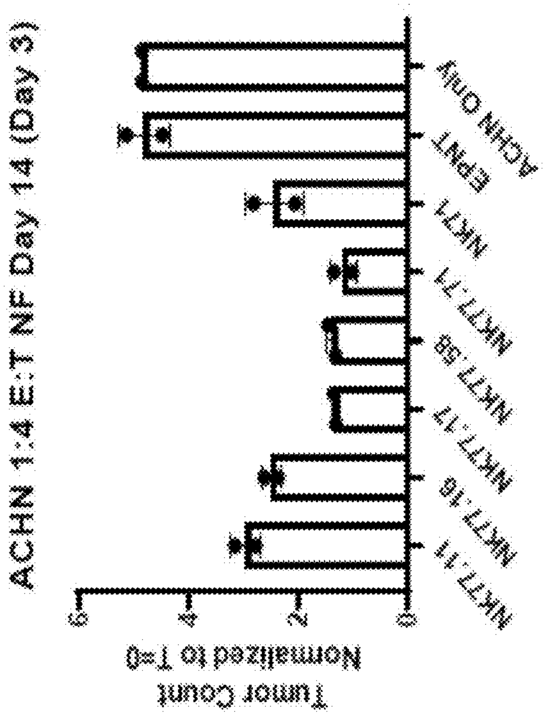

FIGS. 61A-61N shows expression level and cytotoxicity data for additional anti-CD70 CARs in NK cells gene edited to knockout CD70 in another donor. FIG. 61A shows flow cytometry plots showing knockout of CD70 in the donor (denoted donor 512). FIG. 61B shows flow cytometry plots detecting expression of the CAR (by APC anti-FLAG) and loss of expression of CD70 (by PE anti-CD70). FIG. 61C shows the quantification of anti-CD70 CAR and CD70 expression in the NK cell population of FIG. 61B. FIG. 61D shows the raw MFI used to quantify CAR expression of FIG. 61B. FIG. 61E shows the % abundance of the tested anti-CD70 CARs after 1 week of culture. FIG. 61F shows the raw MFI of the tested anti-CD70 CARs after 1 week of culture. FIG. 61G shows the % abundance of the tested anti-CD70 CARs after 2 weeks of culture. FIG. 61H shows the raw MFI of the tested anti-CD70 CARs after 2 weeks of culture. FIG. 61I shows the % abundance of the tested anti-CD70 CARs after 3 weeks of culture. FIG. 61J shows the raw MFI of the tested anti-CD70 CARs after 3 weeks of culture. FIG. 61K shows cytotoxicity data of the tested NK cells against 786-O cells at a 1:2 E:T ratio at 3 days of a 14 day total culture. FIG. 61L shows cytotoxicity data of the tested NK cells against 786-O cells at a 1:4 E:T ratio at 3 days of a 14 day total culture. FIG. 61M shows cytotoxicity data of the tested NK cells against ACHN cells at a 1:2 ratio at 3 days of a 14 day total culture. FIG. 61N shows cytotoxicity data of the tested NK cells against ACHN cells at a 1:4 ratio at 3 days of a 14 day total culture.

Figure 62A:
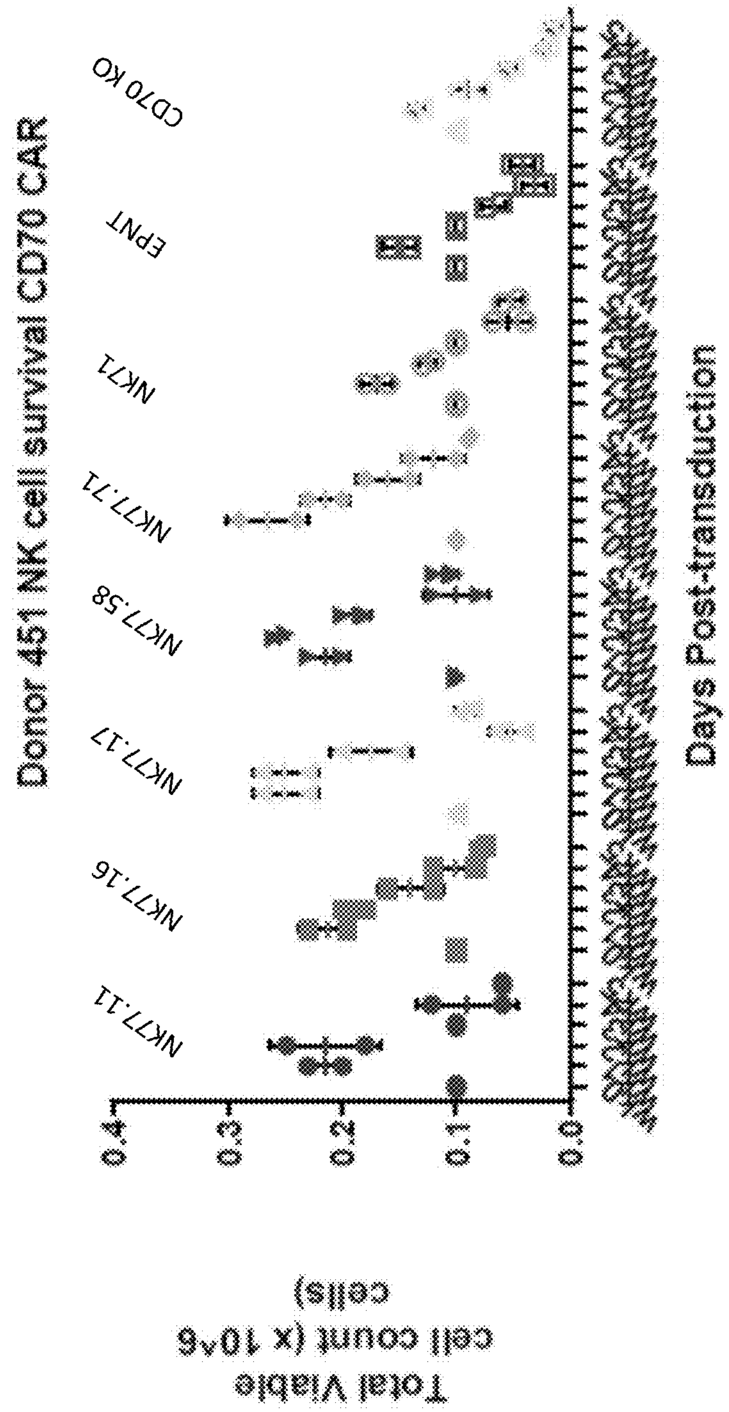
Figure 62B:
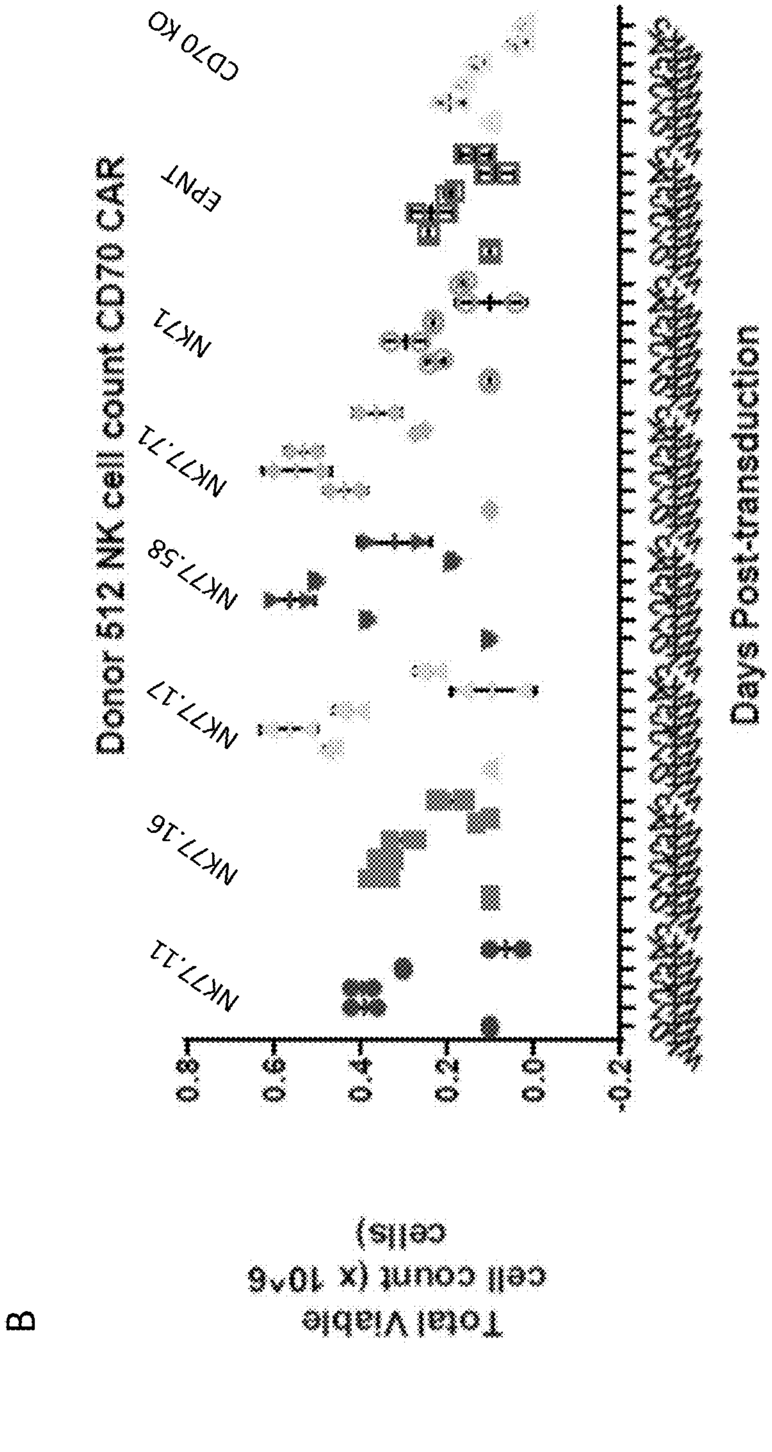

FIGS. 62A-62B show NK cell survival over 5 weeks (week 0 to week 5) after transduction with tested anti-CD70 CARs. FIG. 62A shows survival of NK cells from one donor (denoted donor 451). FIG. 62B shows survival of NK cells from another donor (denoted donor 512).

Figure 63A:
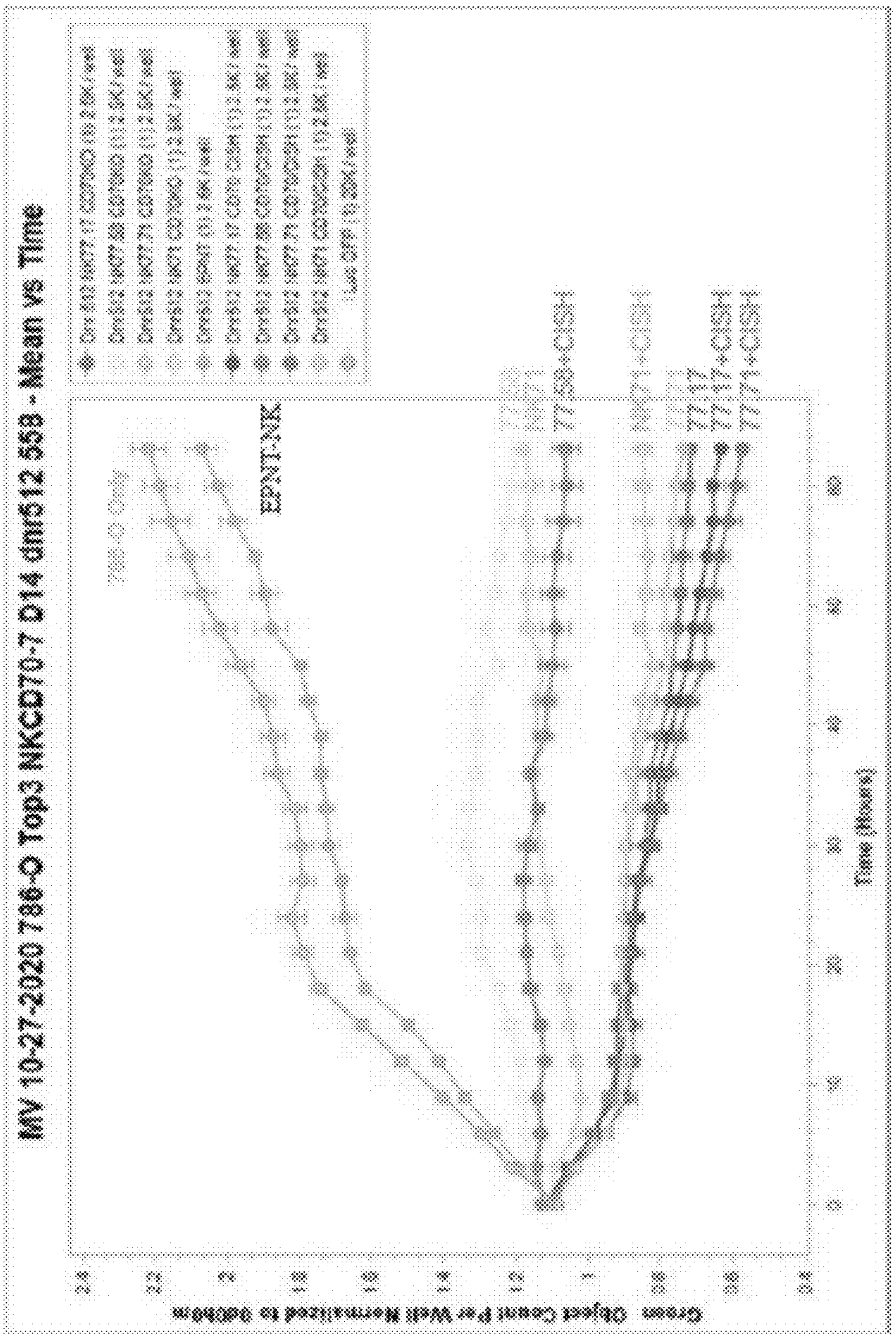
Figure 63B:
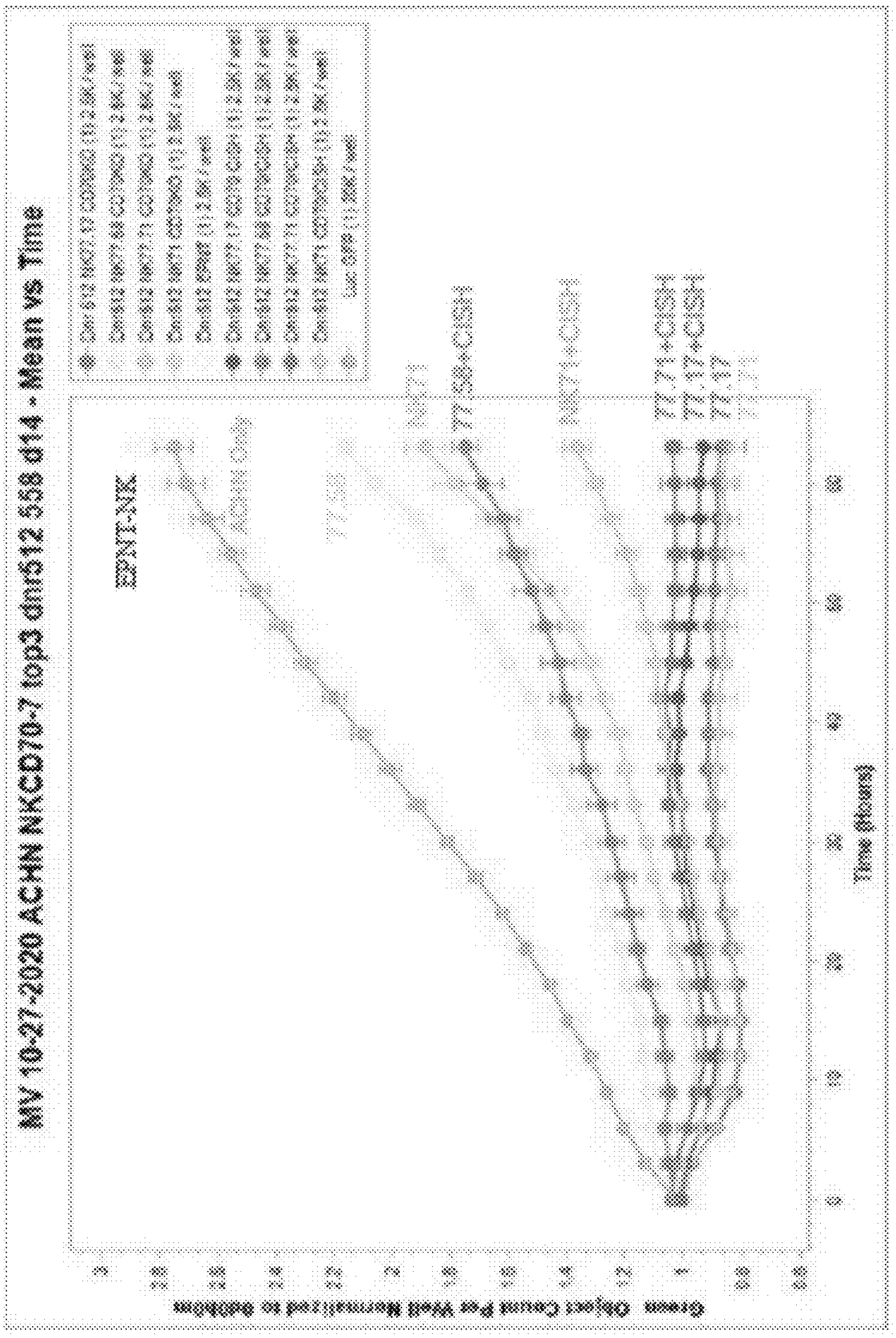

FIGS. 63A-63B show cytotoxicity data of tested NK cells gene expressing anti-CD70 CARs and gene edited to knockout CD70 and optionally CISH. FIG. 63A shows cytotoxicity data of tested NK cells against 786-O cells at a 1:8 ratio, for up to 64 hours. FIG. 63B shows cytotoxicity data of tested NK cells against ACHN cells at a 1:8 ratio, for up to 64 hours.

Figure 64A:
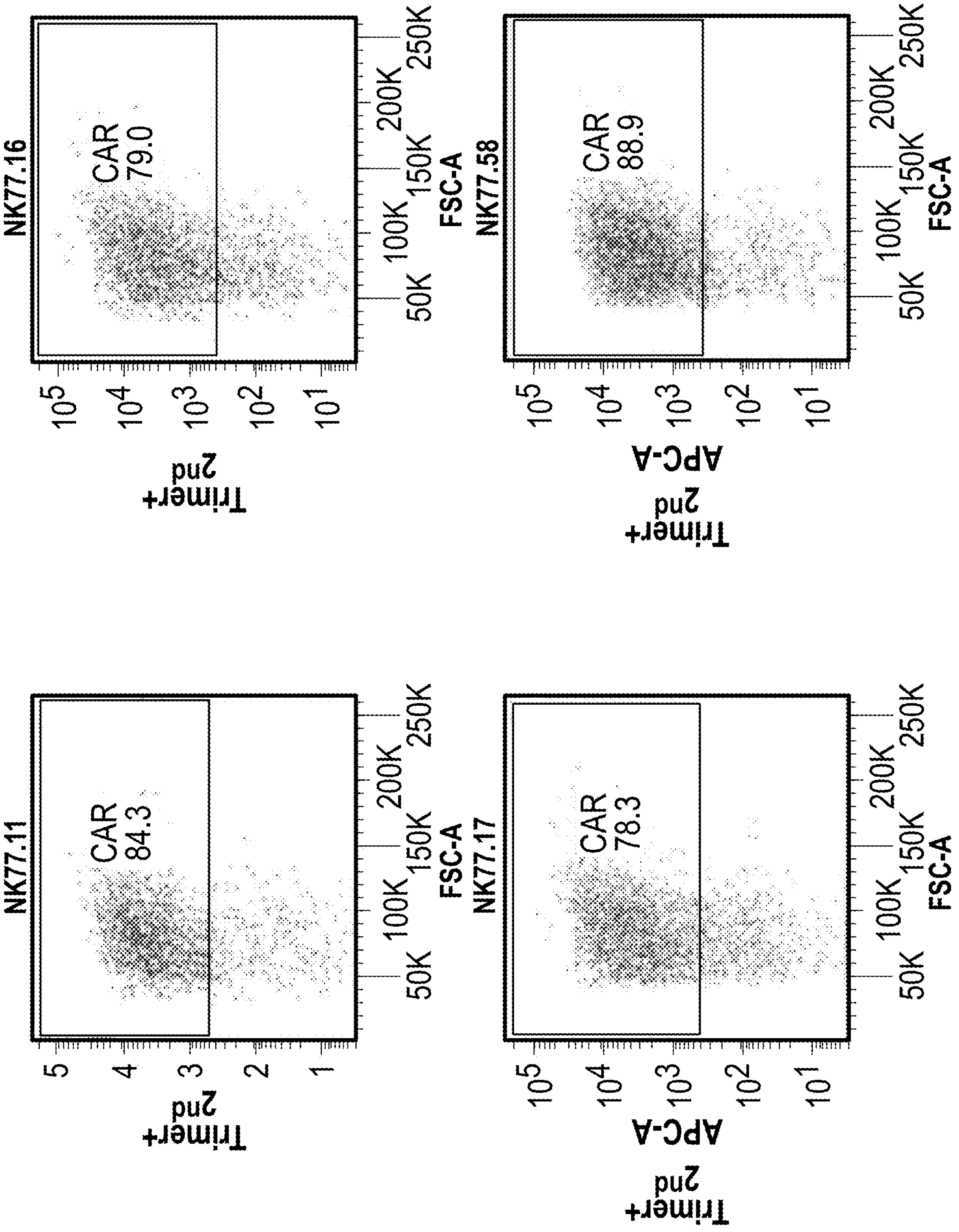
Figure 64A:
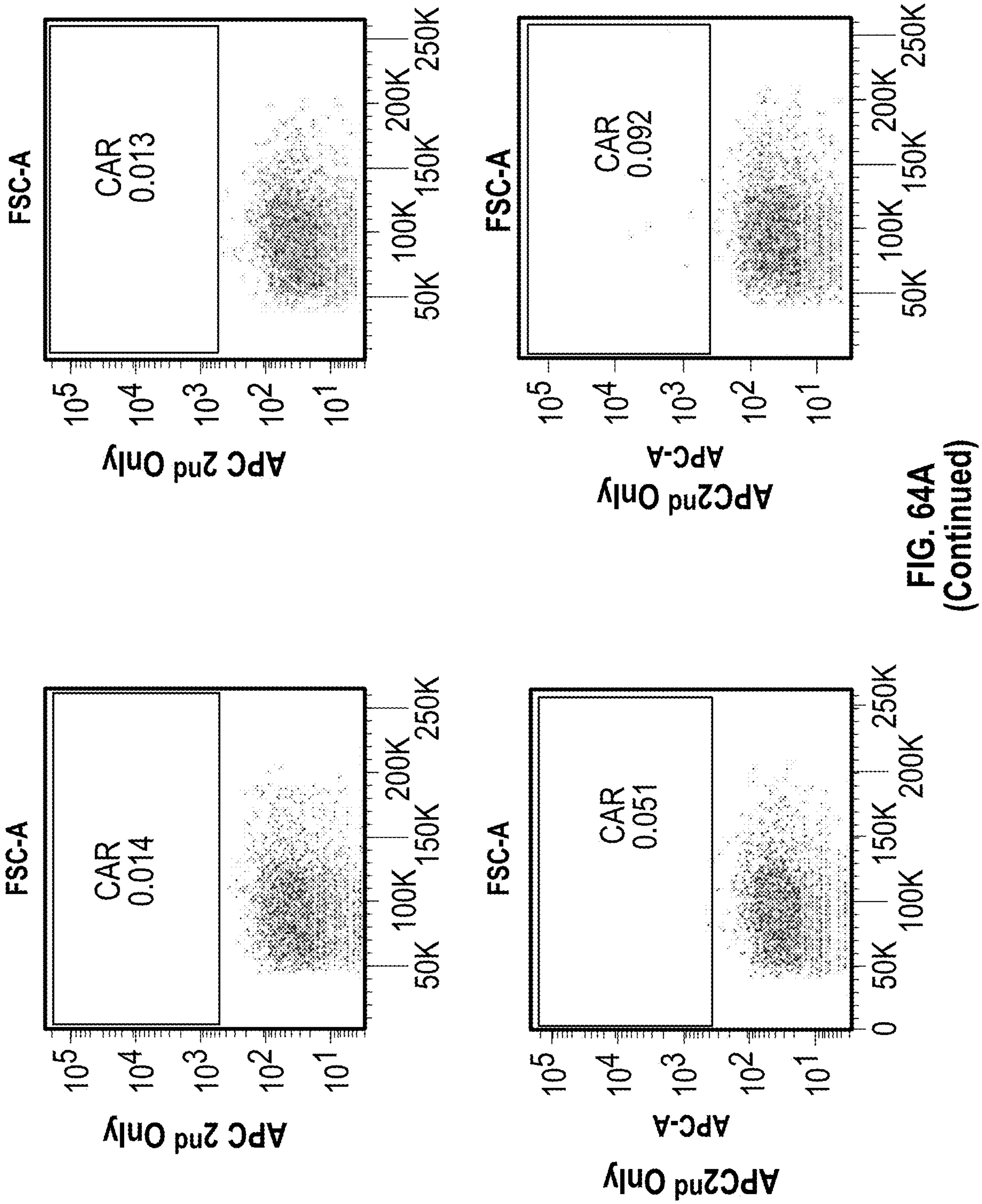
Figure 64A:
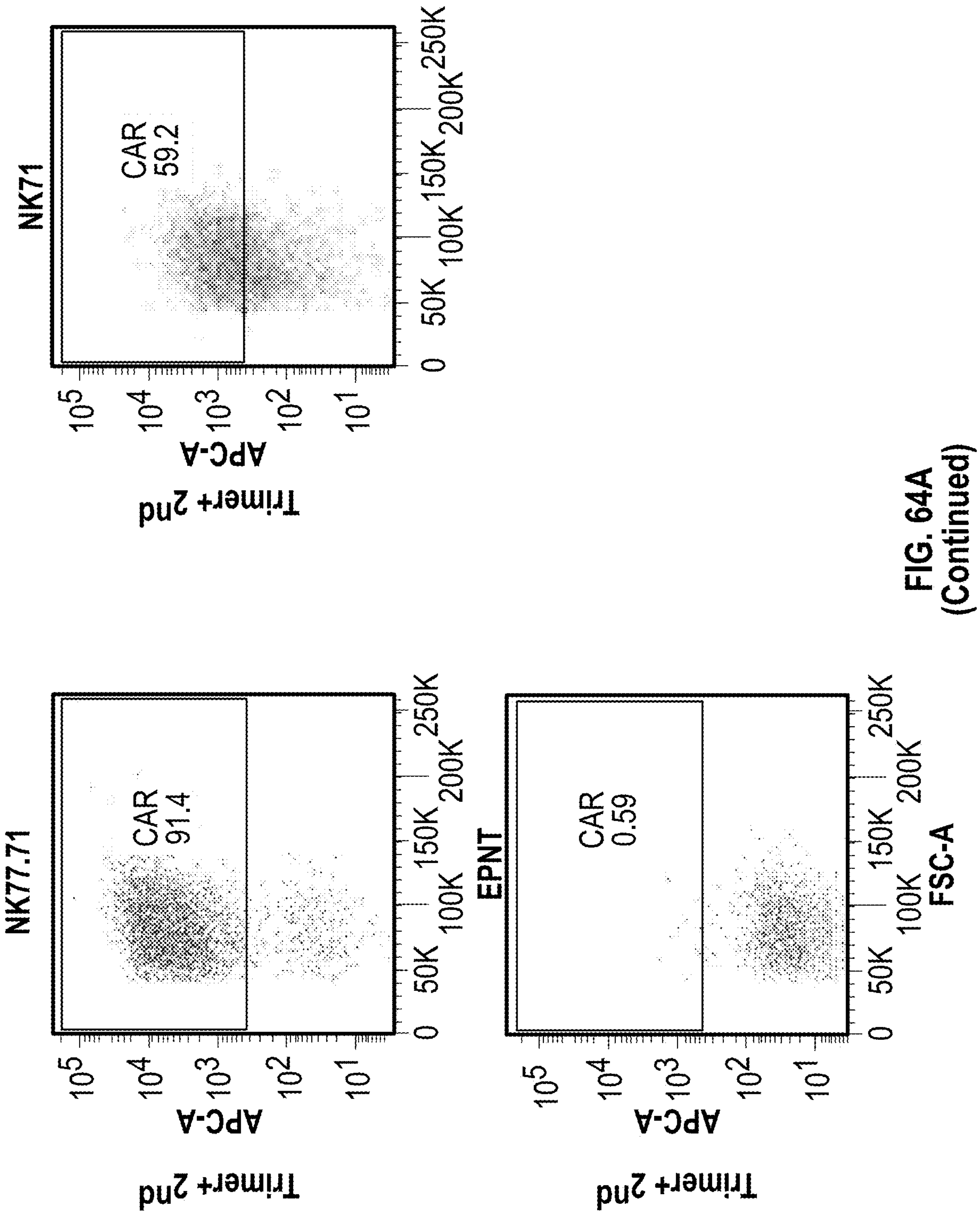
Figure 64A:
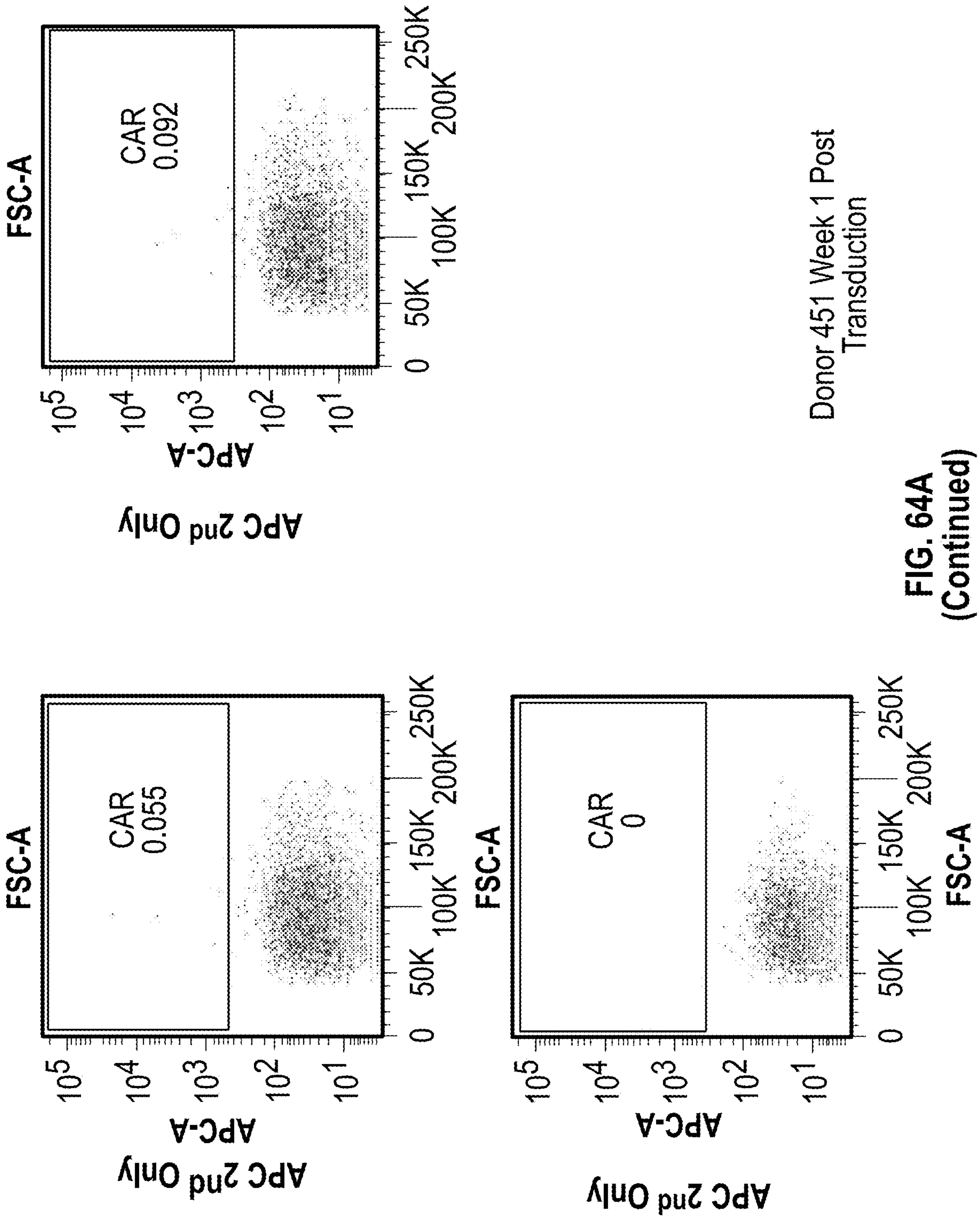
Figure 64B:
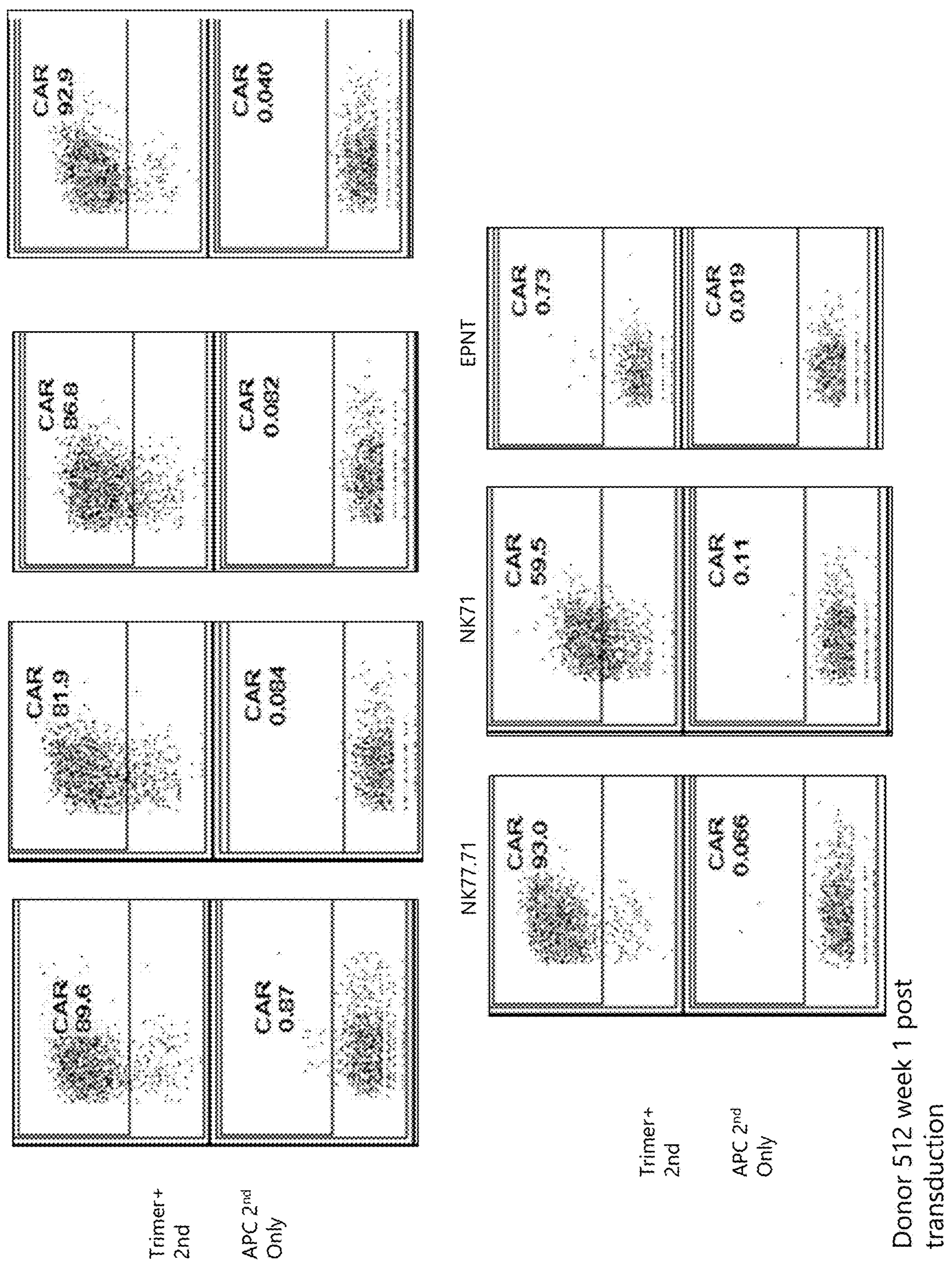
Figure 64E:
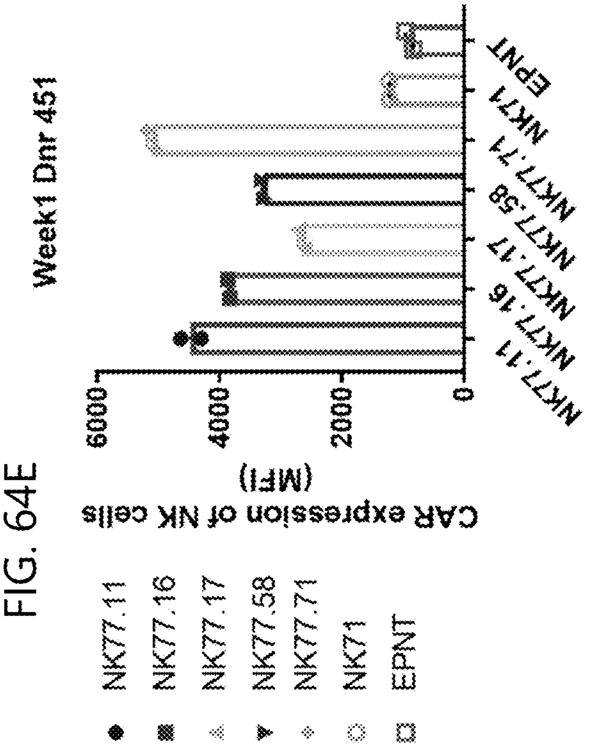
Figure 64F:
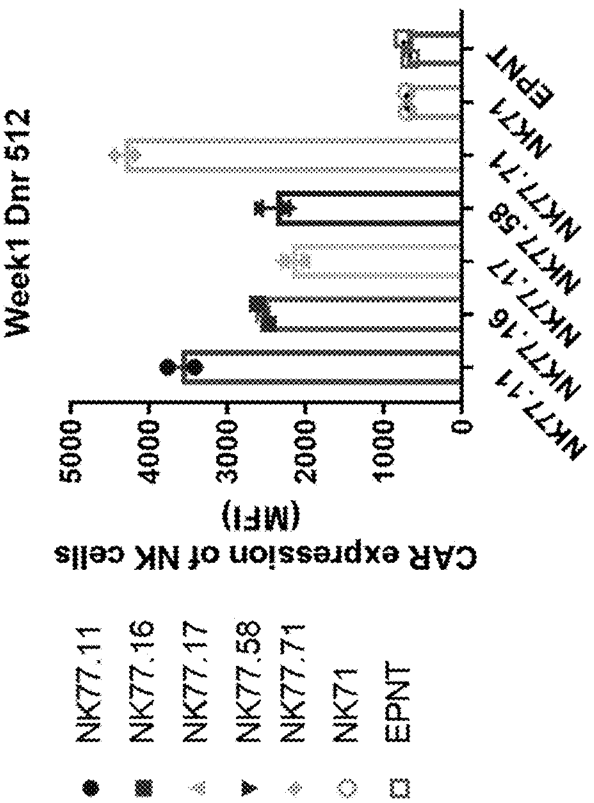
Figure 64G:
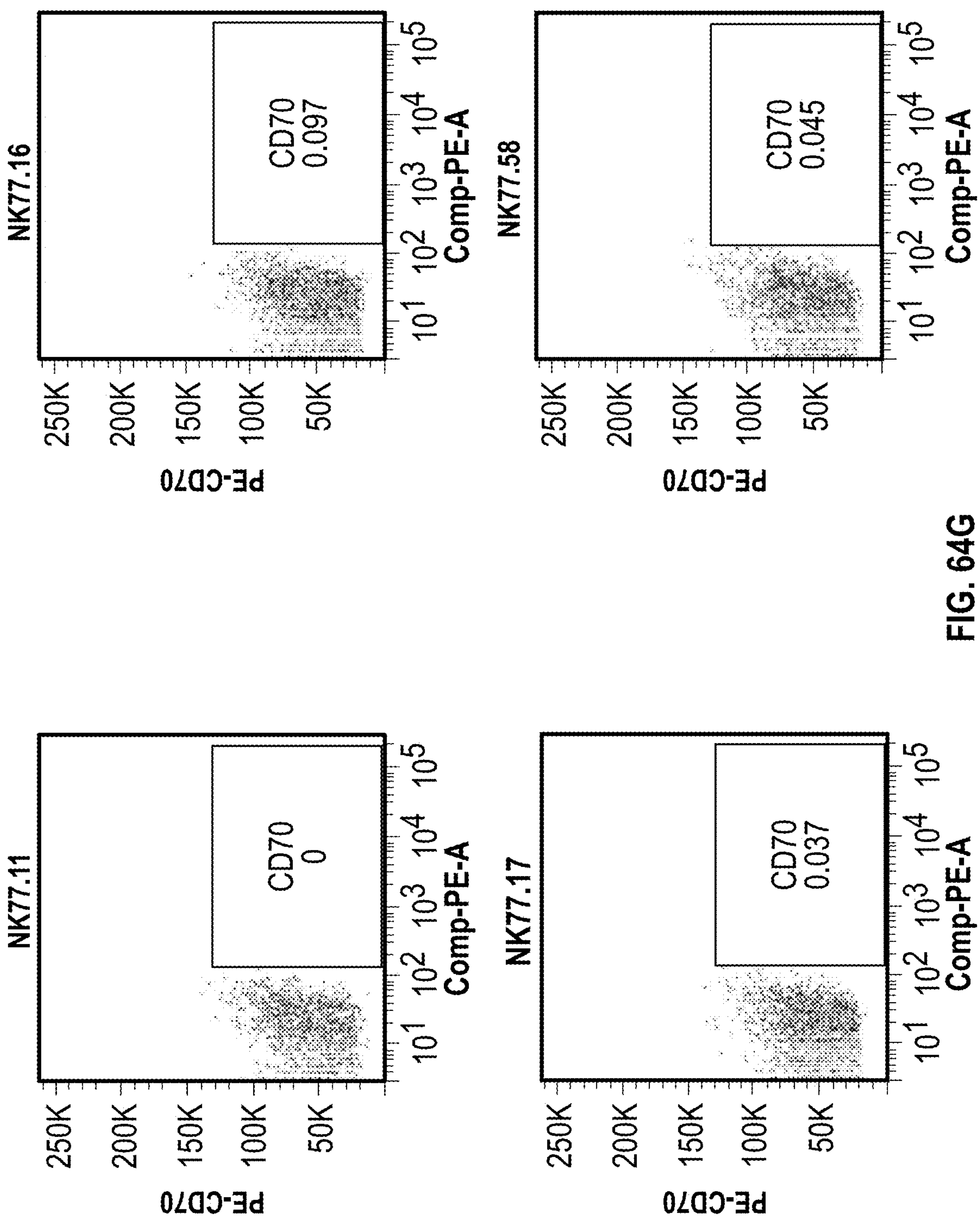
Figure 64G:
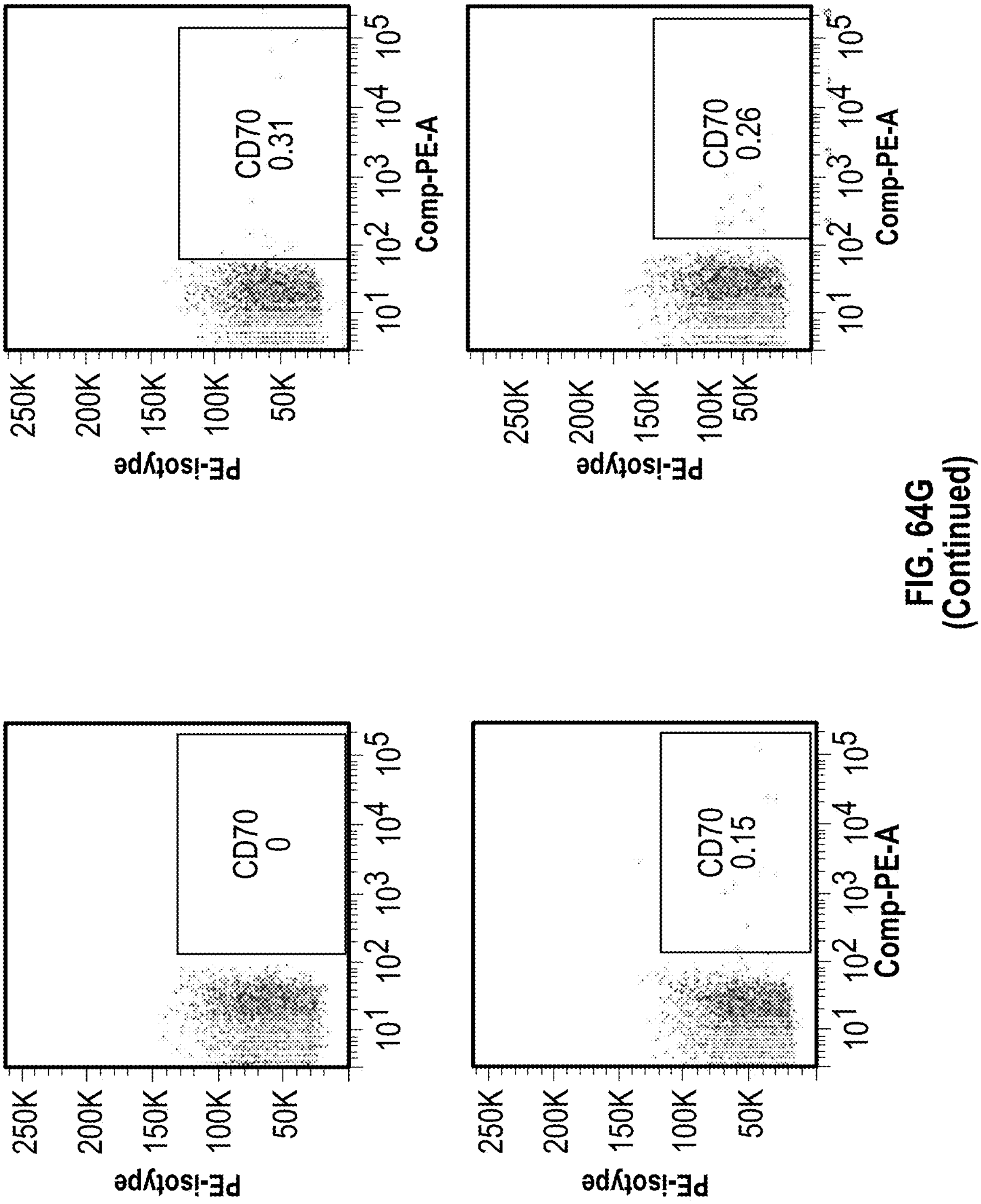
Figure 64G:
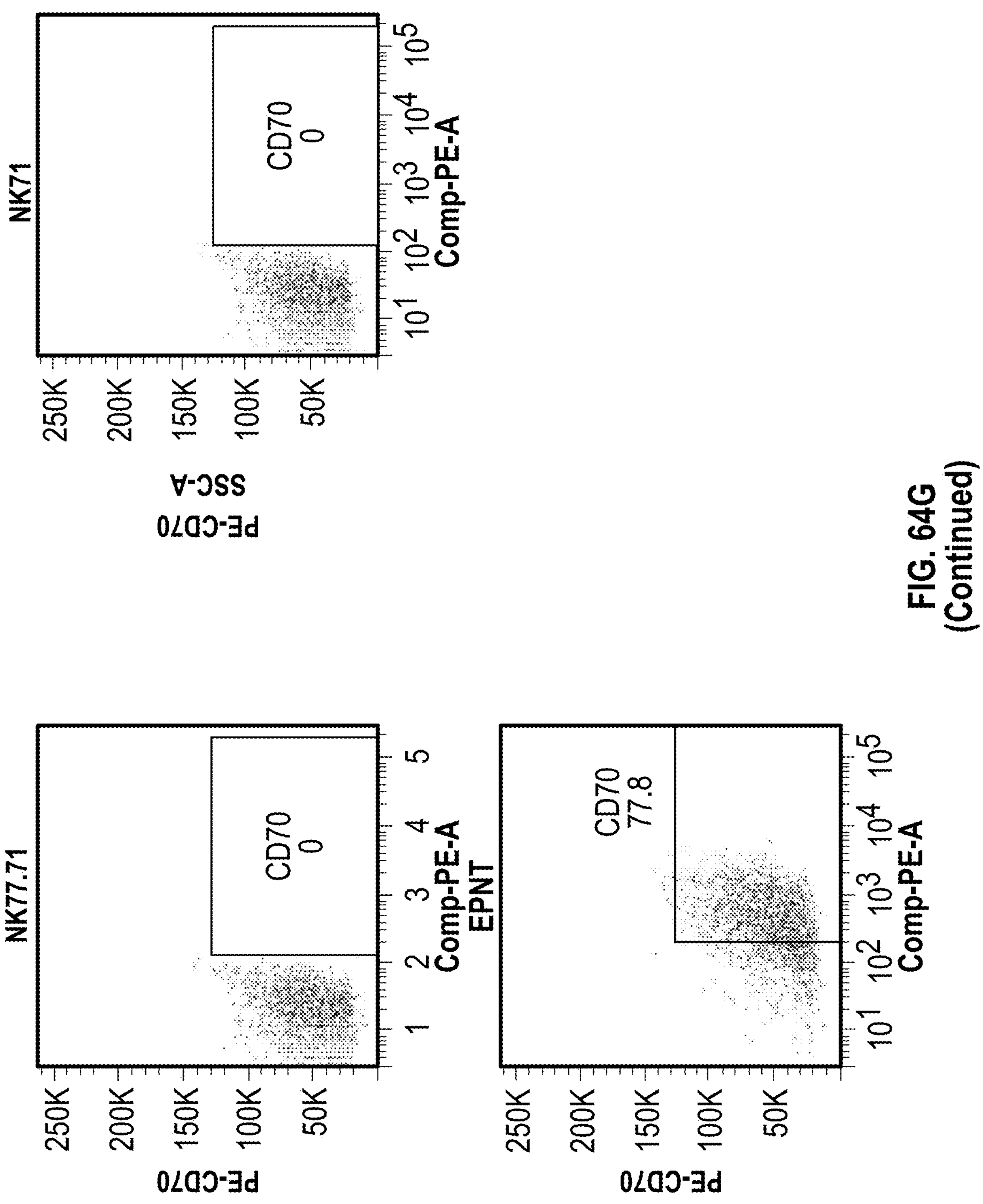
Figure 64G:
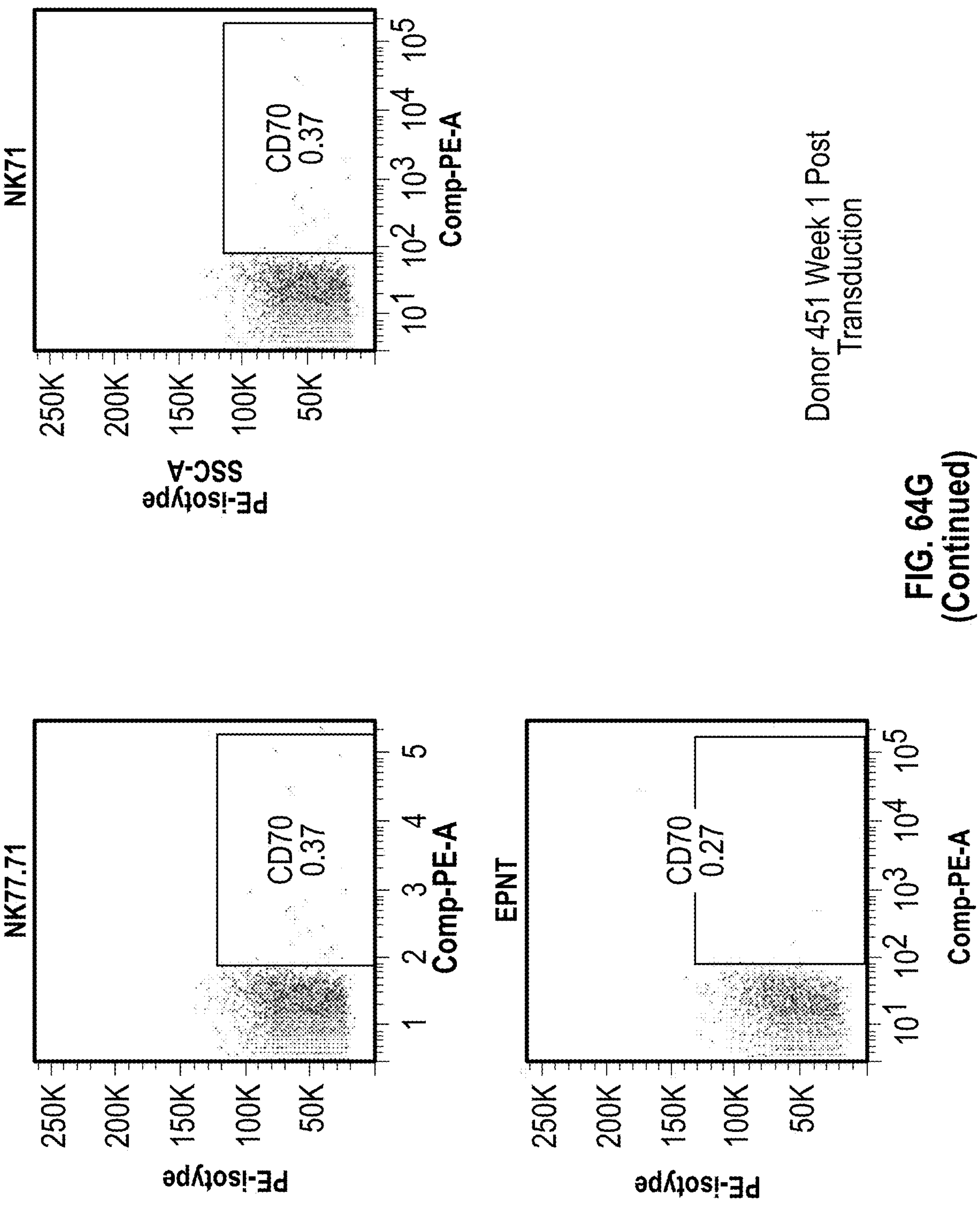
Figure 64H:
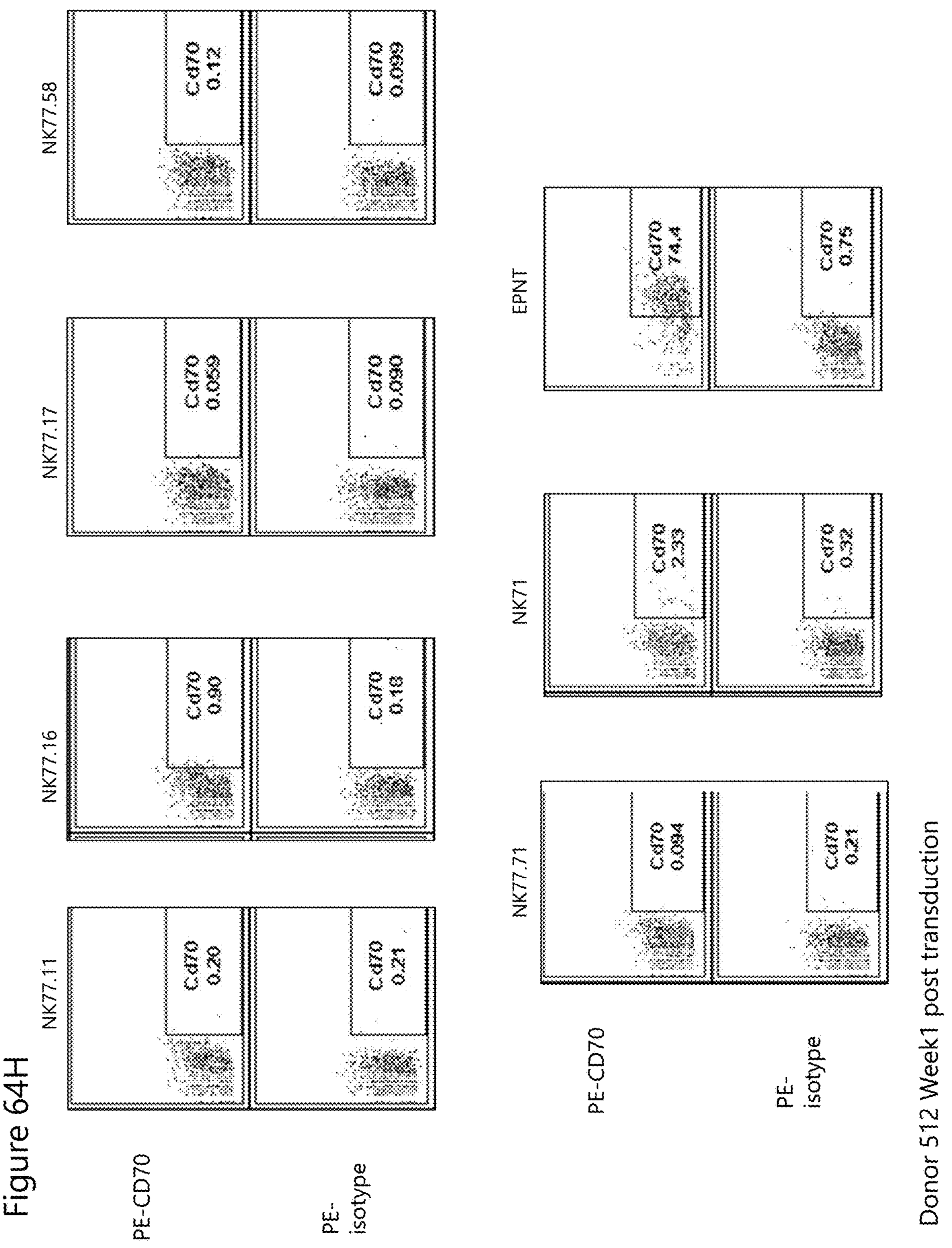

FIGS. 64A-64J show further data related to screening of various CD70 CAR constructs expressed by NK cells and characterization of CD70 gene knockout. FIG. 64A shows data for the indicated CD70 CAR constructs and their ability, when expressed by NK cells, to bind a trimer of CD70 (native CD70 conformation) as measured week 1 post-transduction with the CAR (which is 1 week past the phenotypic analysis of CD70 expression post-gene editing shown in FIGS. 61A-61B). FIG. 64B shows similar data from another donor. FIGS. 64C and 64D shows summary data from the flow cytometry binding data, expressed as a percentage of the NK cell population that is binding the CD70 trimer, or as the detected mean fluorescence intensity (MFI) for the two respective donors. FIGS. 64E and 64F show graphical summary data for the relative expression of each of the indicated CAR constructs by NK cells, as measured by MFI. FIGS. 64G and 64H show flow cytometry plots depicting knockout of CD70 expression in the NK cells from two donors and FIGS. 64I and 64J show the summary data of the percent of NK cells expressing CD70 as a percentage and by MFI for both donors.

Figure 65A:
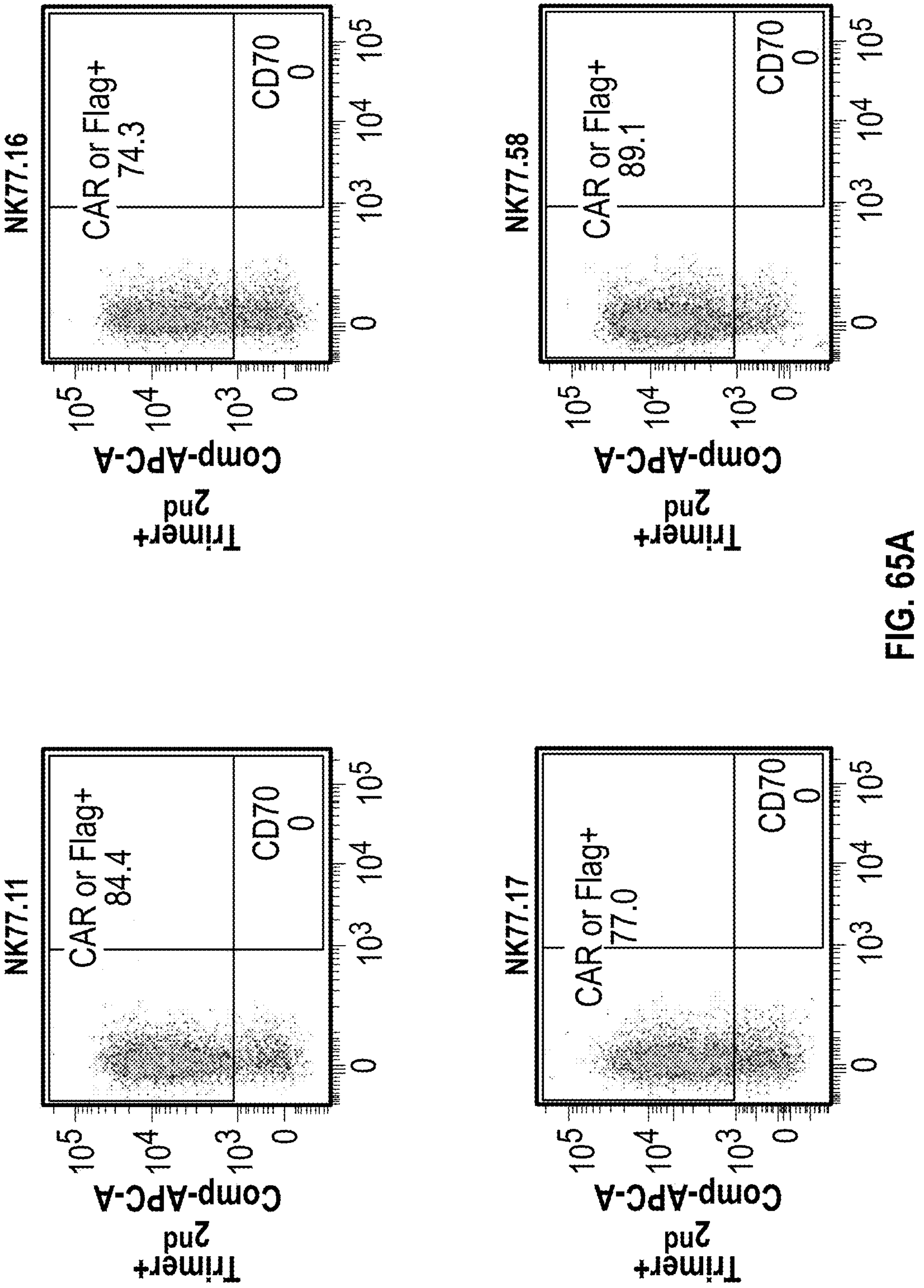
Figure 65A:
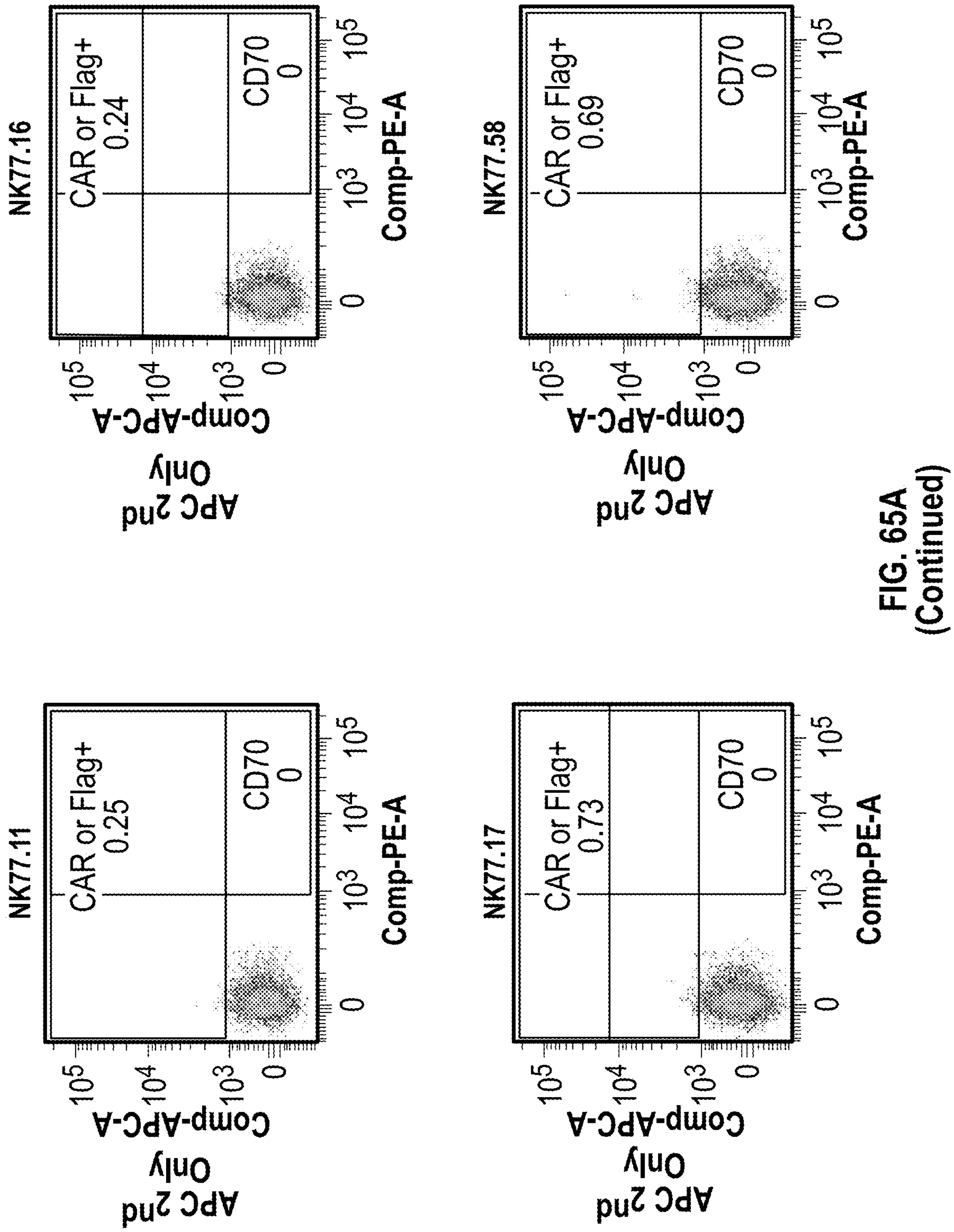
Figure 65A:
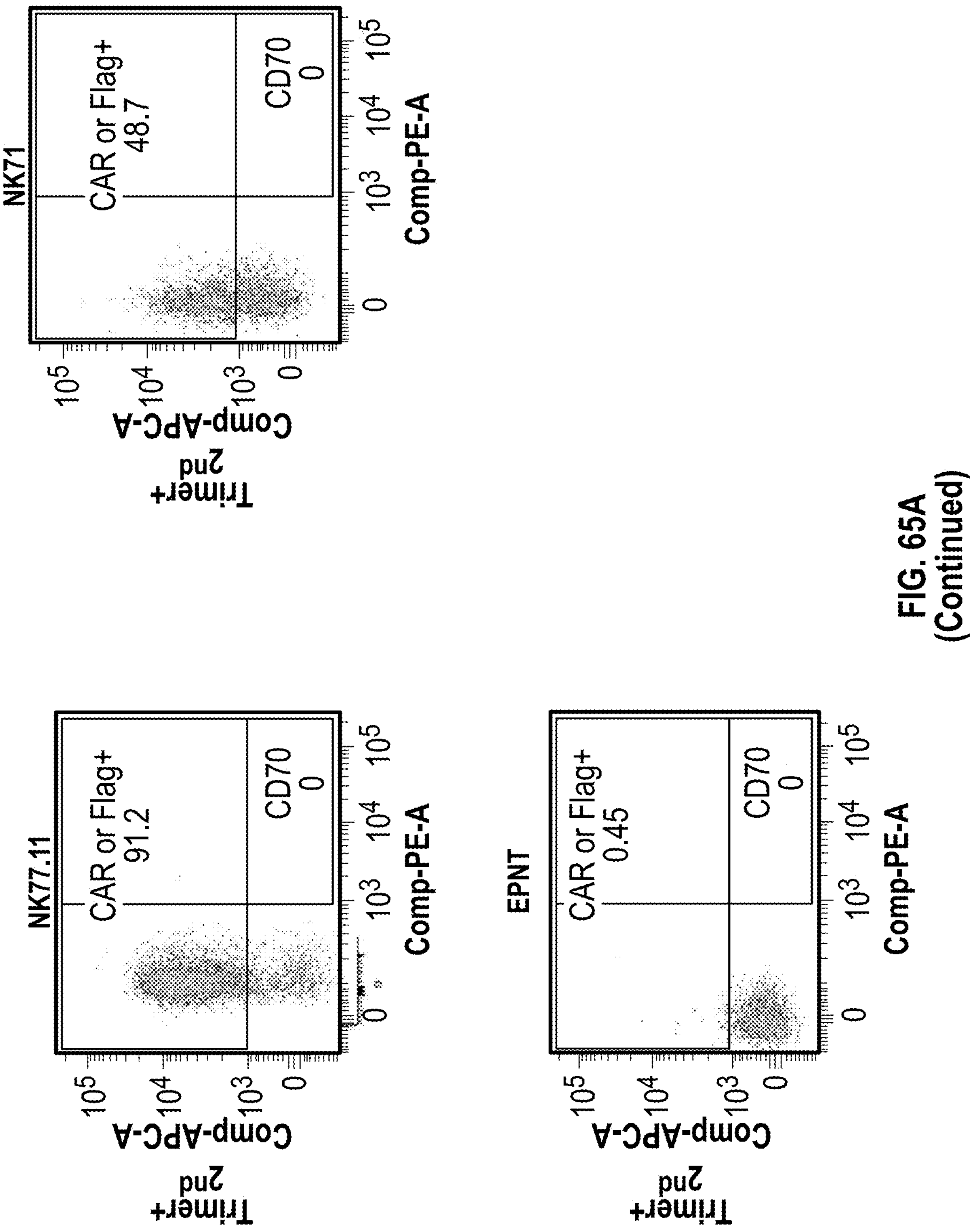
Figure 65A:
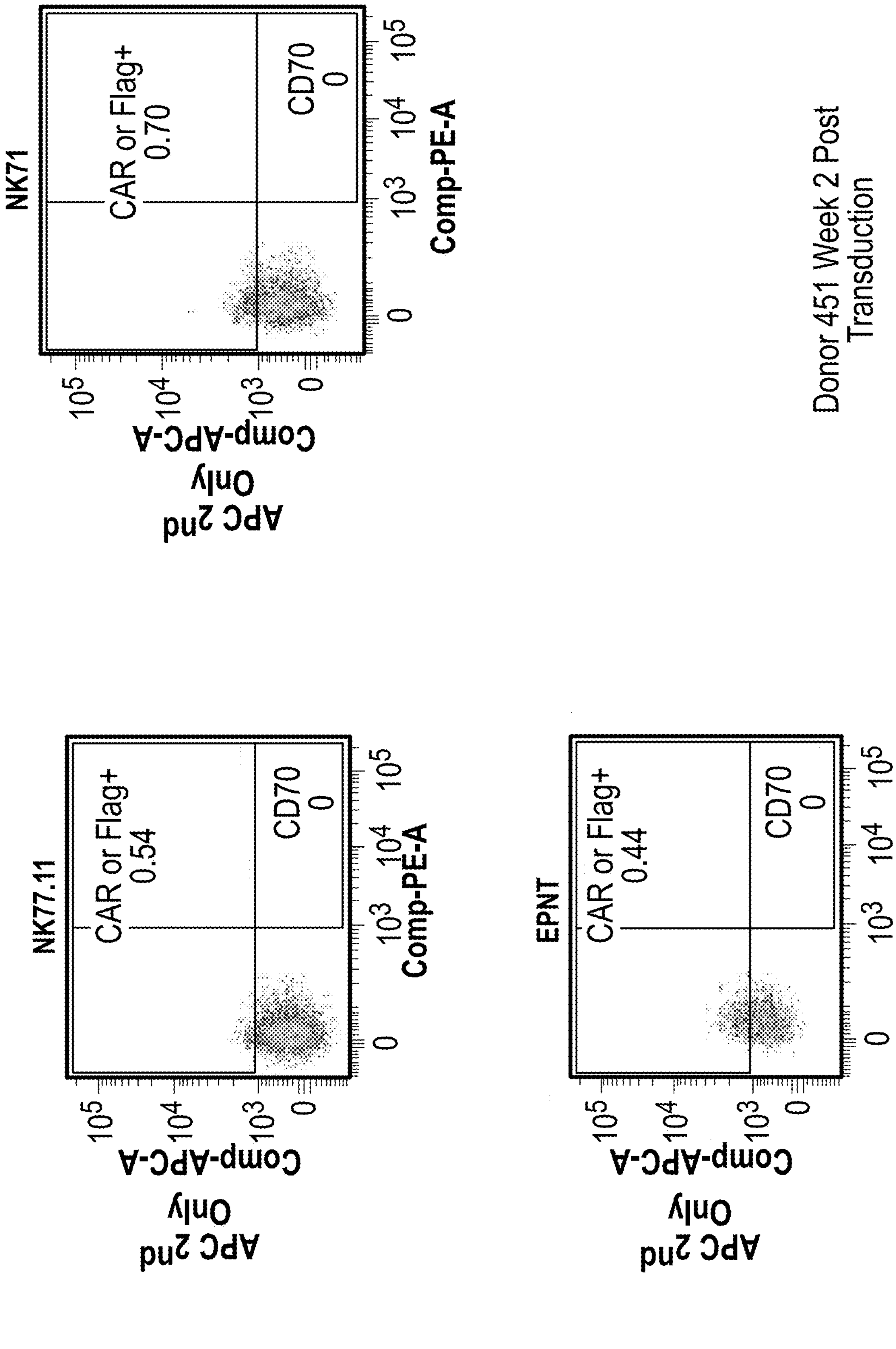
Figure 65B:
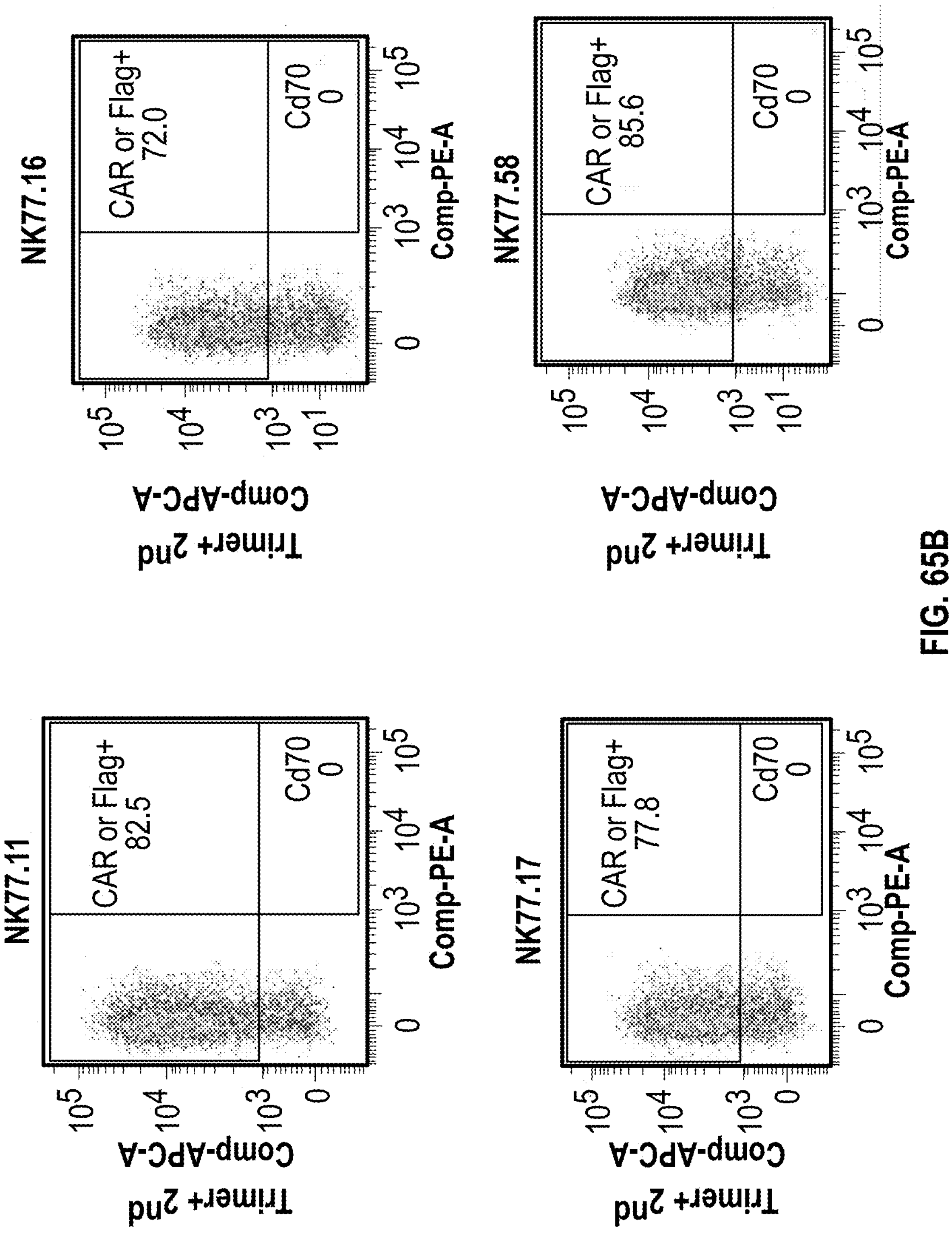
Figure 65B:
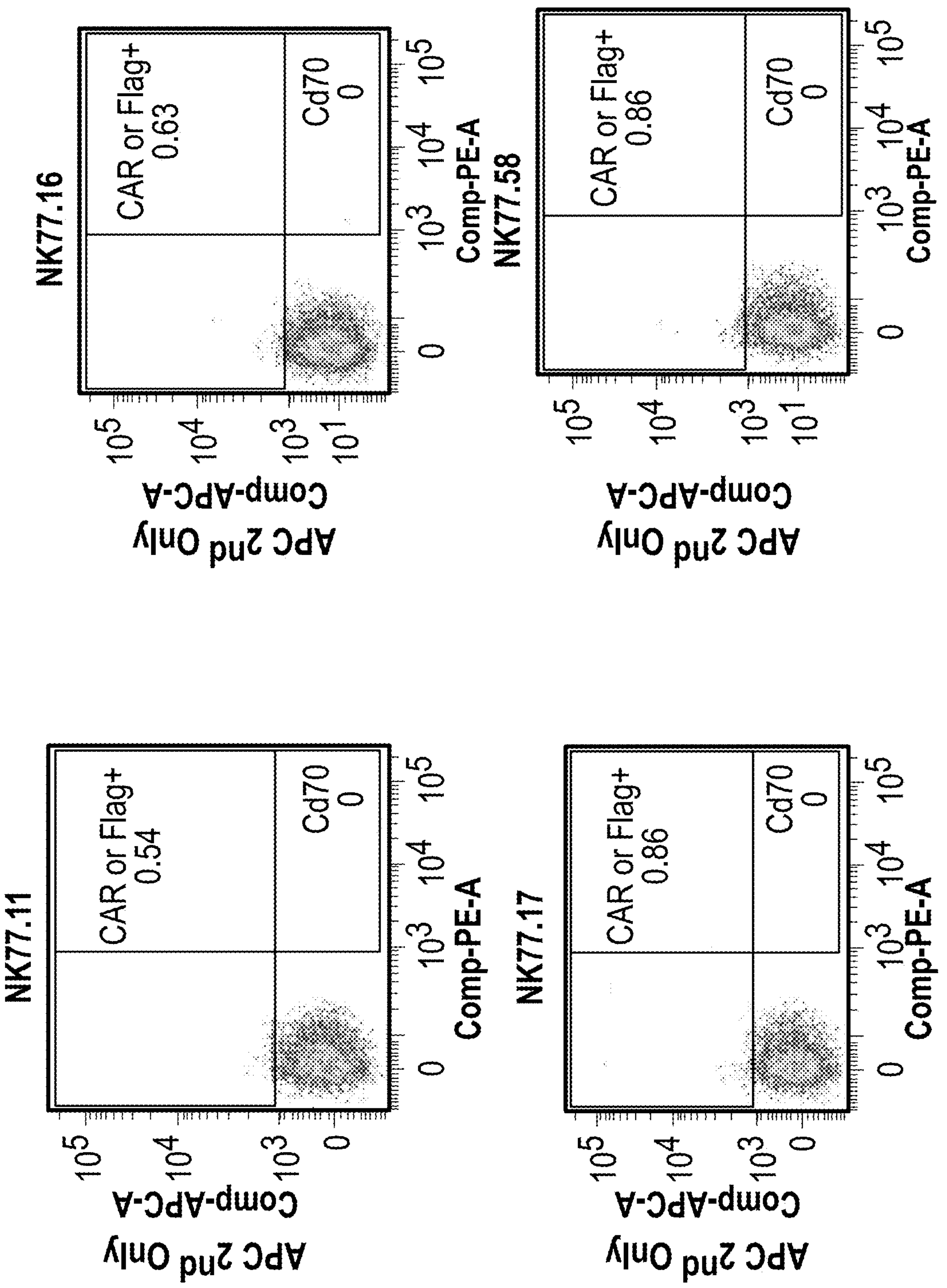
Figure 65B:
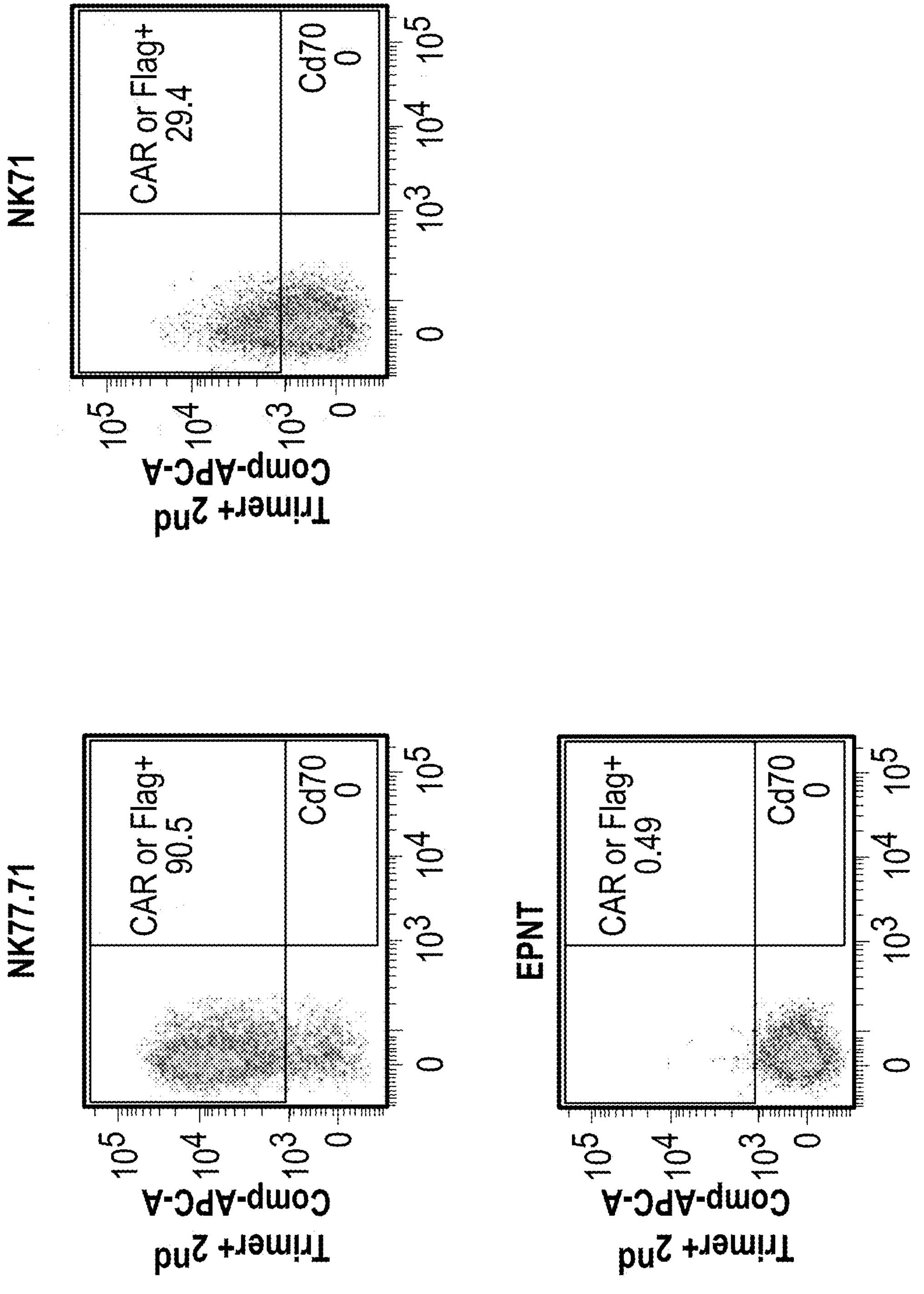
Figure 65B:
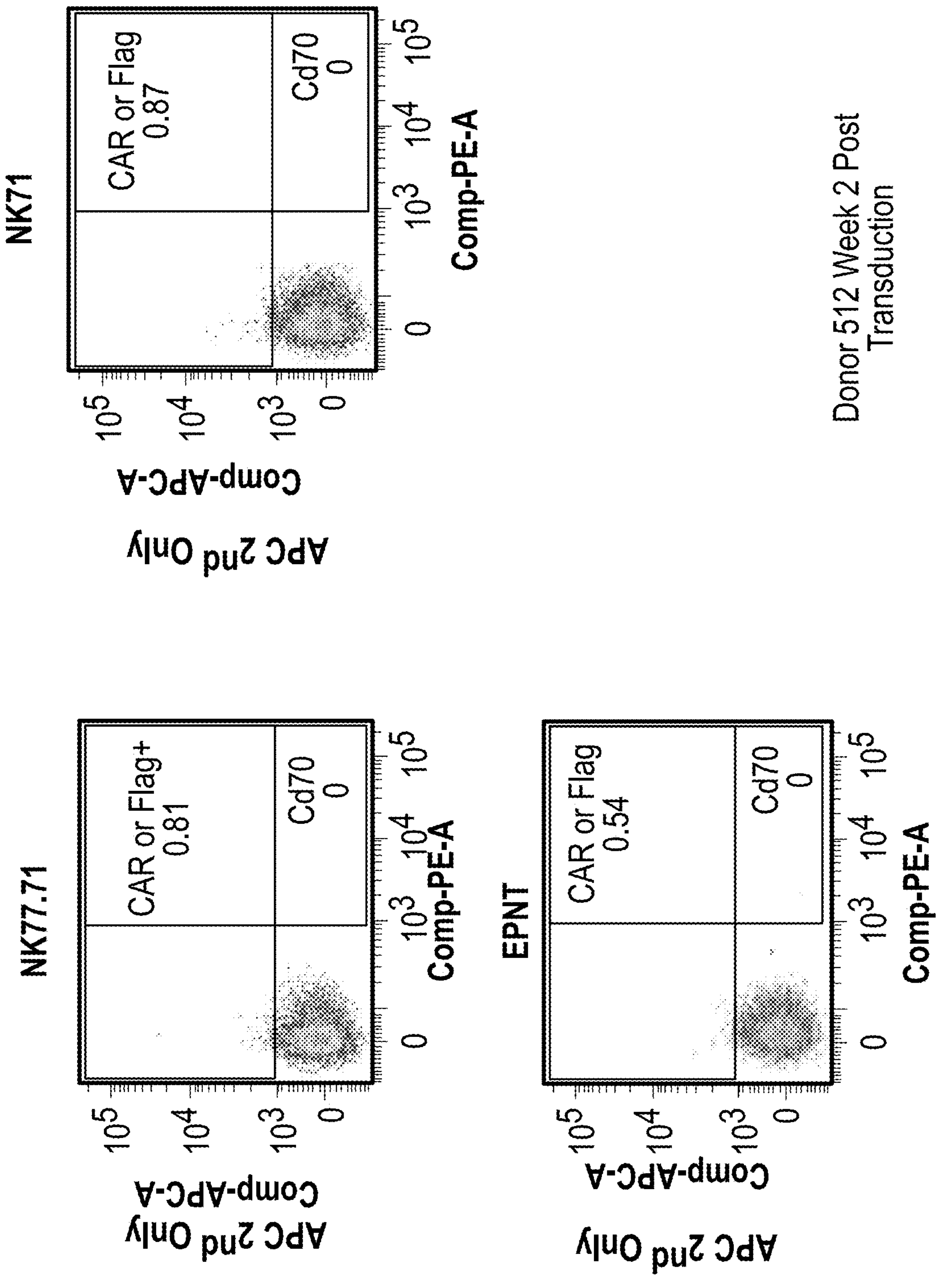
Figure 65F:
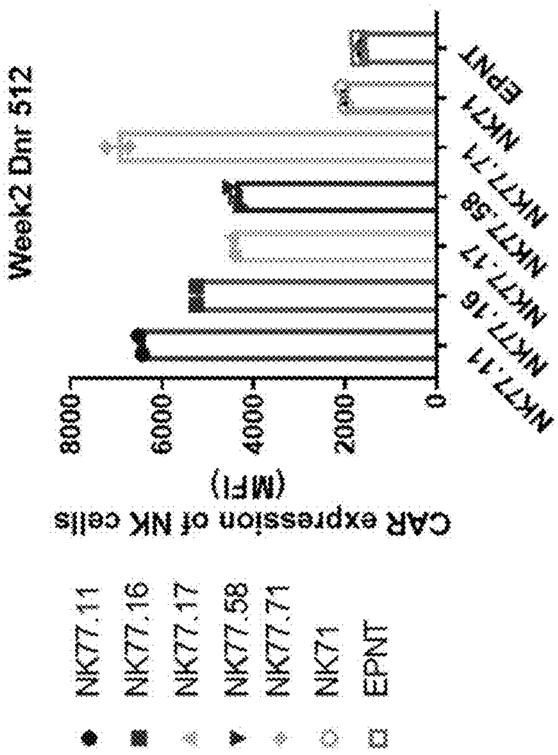
Figure 65E:
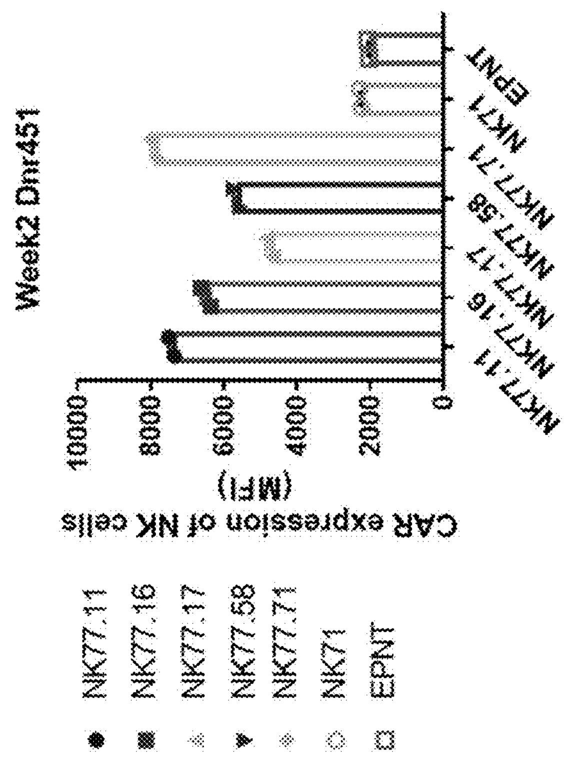
Figure 65G:
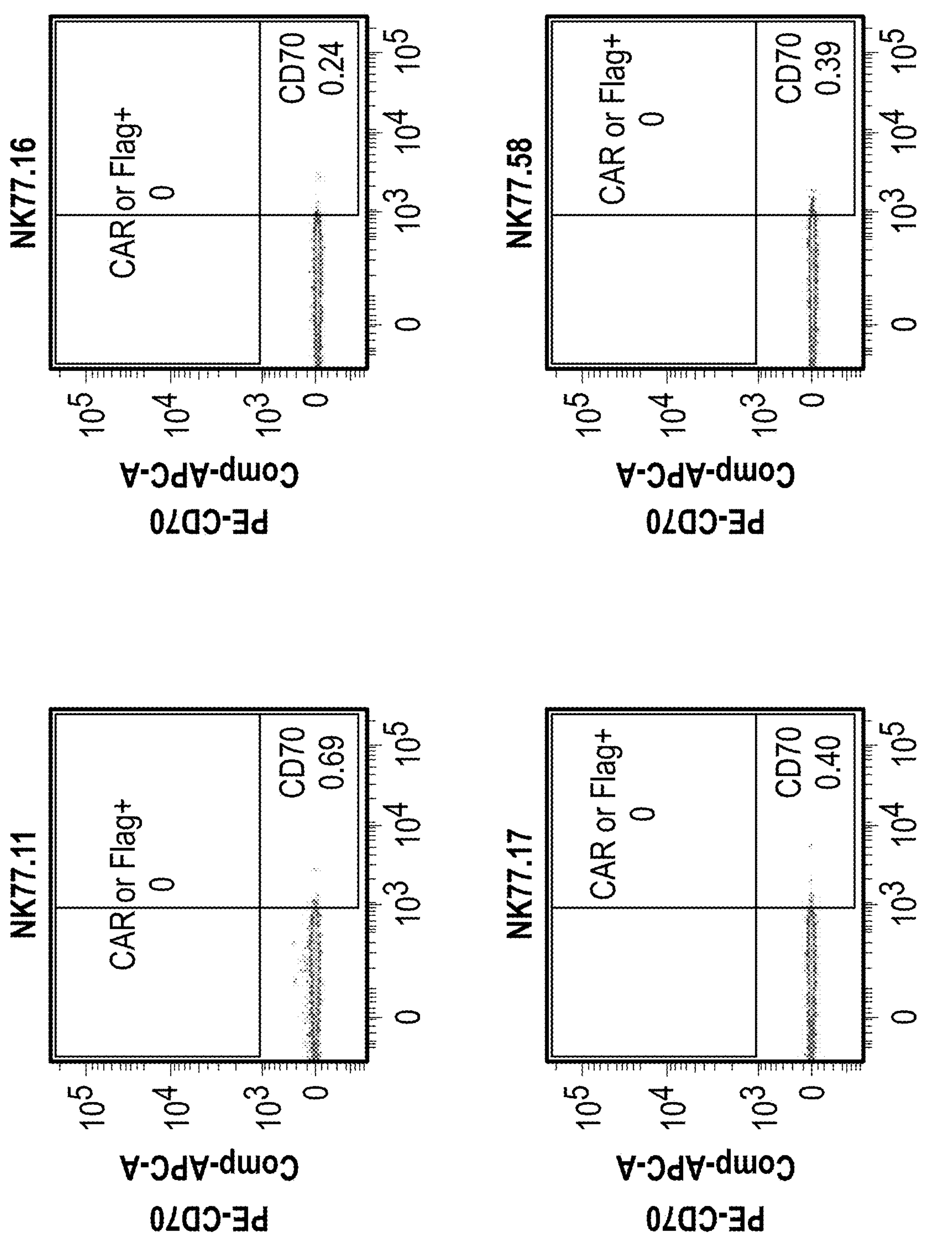
Figure 65G:
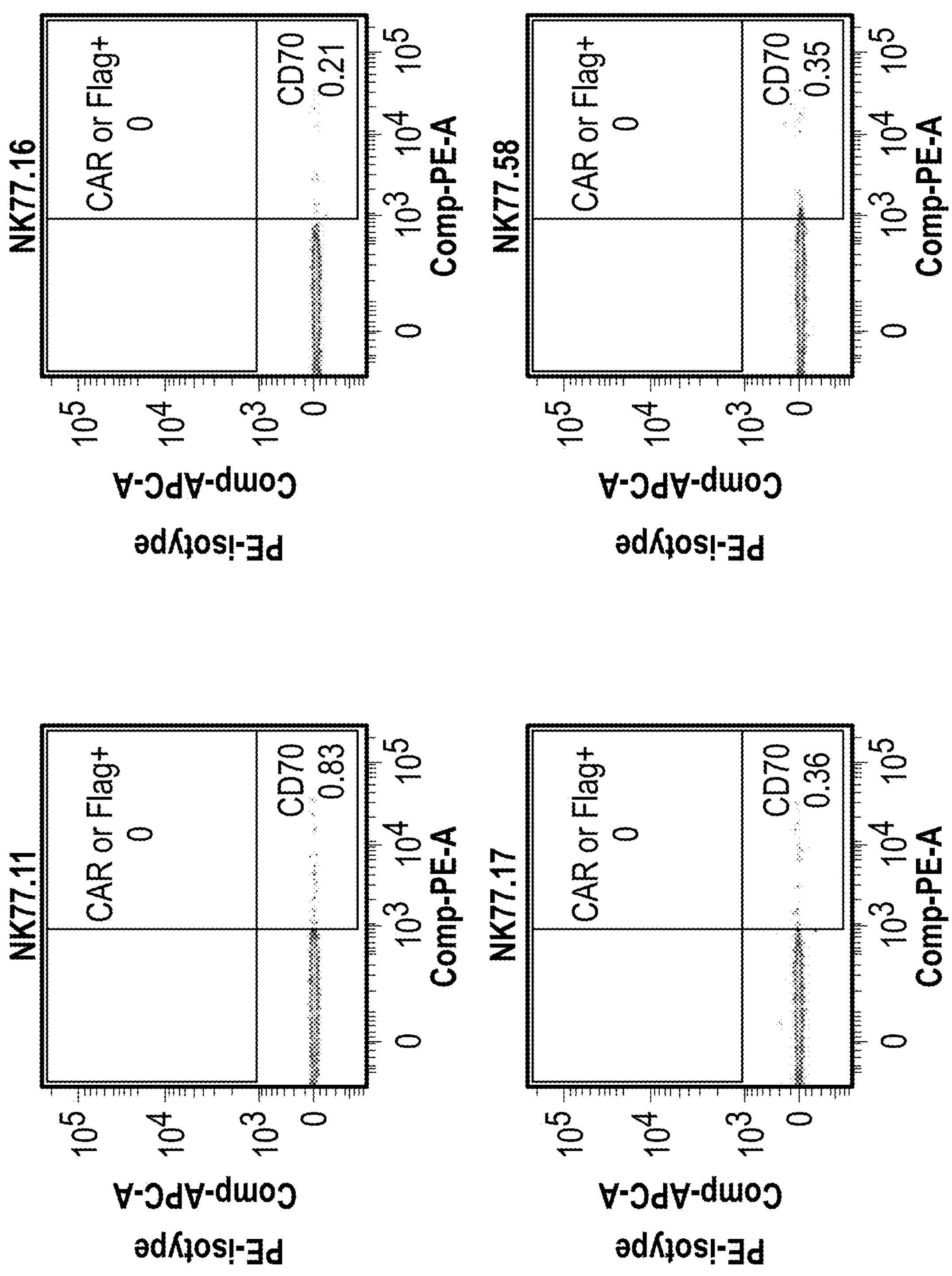
Figure 65G:
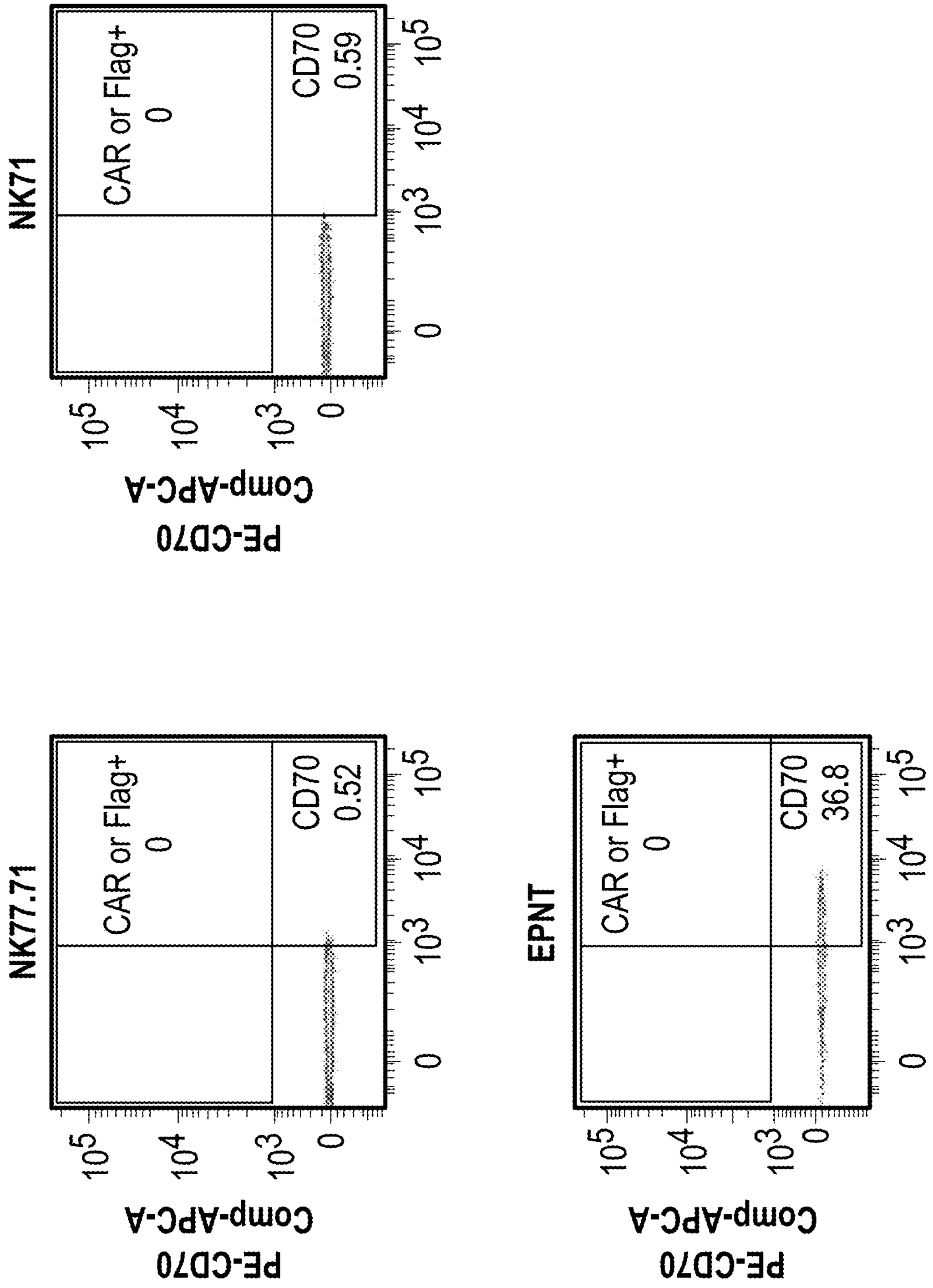
Figure 65G:
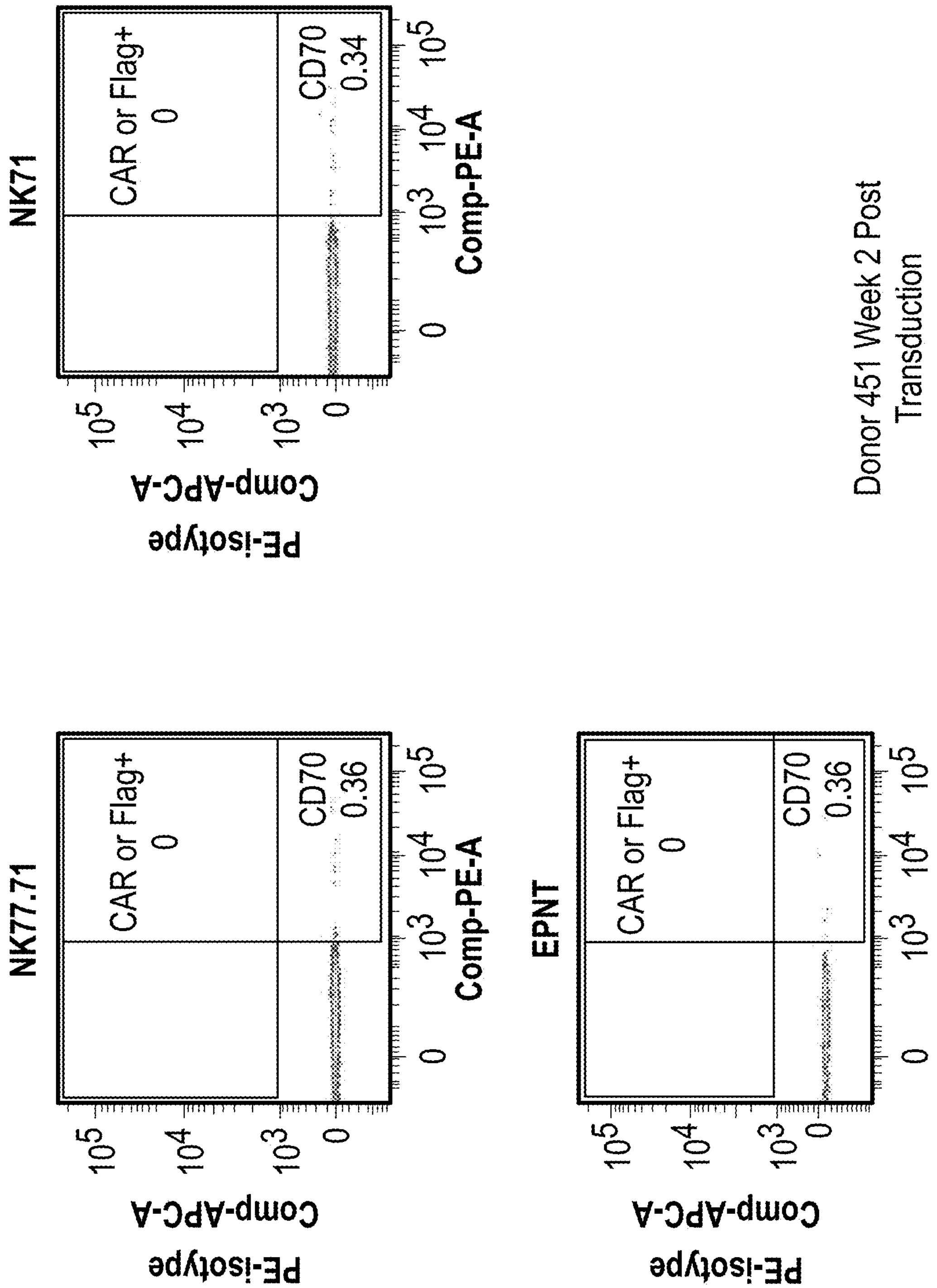
Figure 65H:
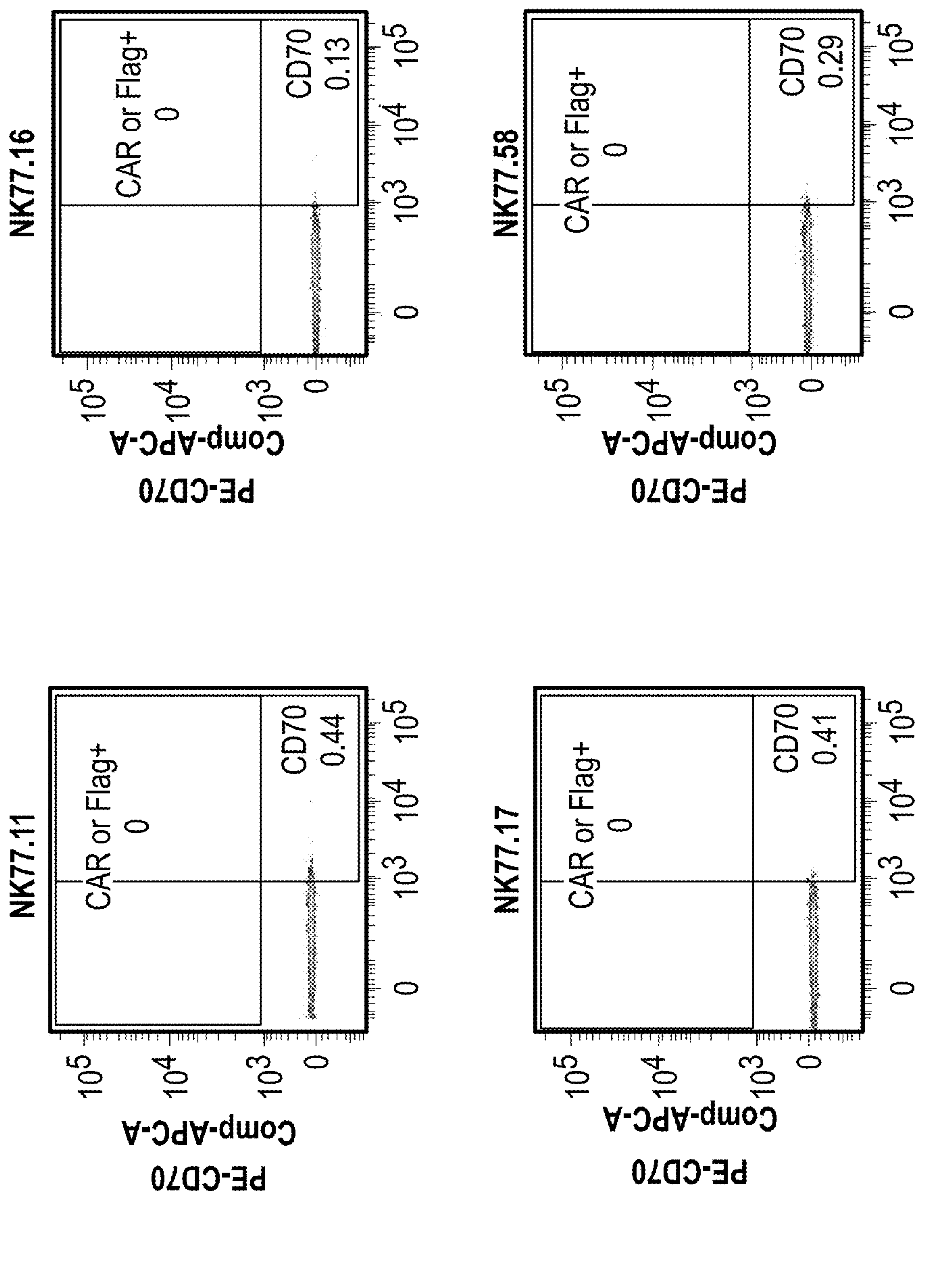
Figure 65H:
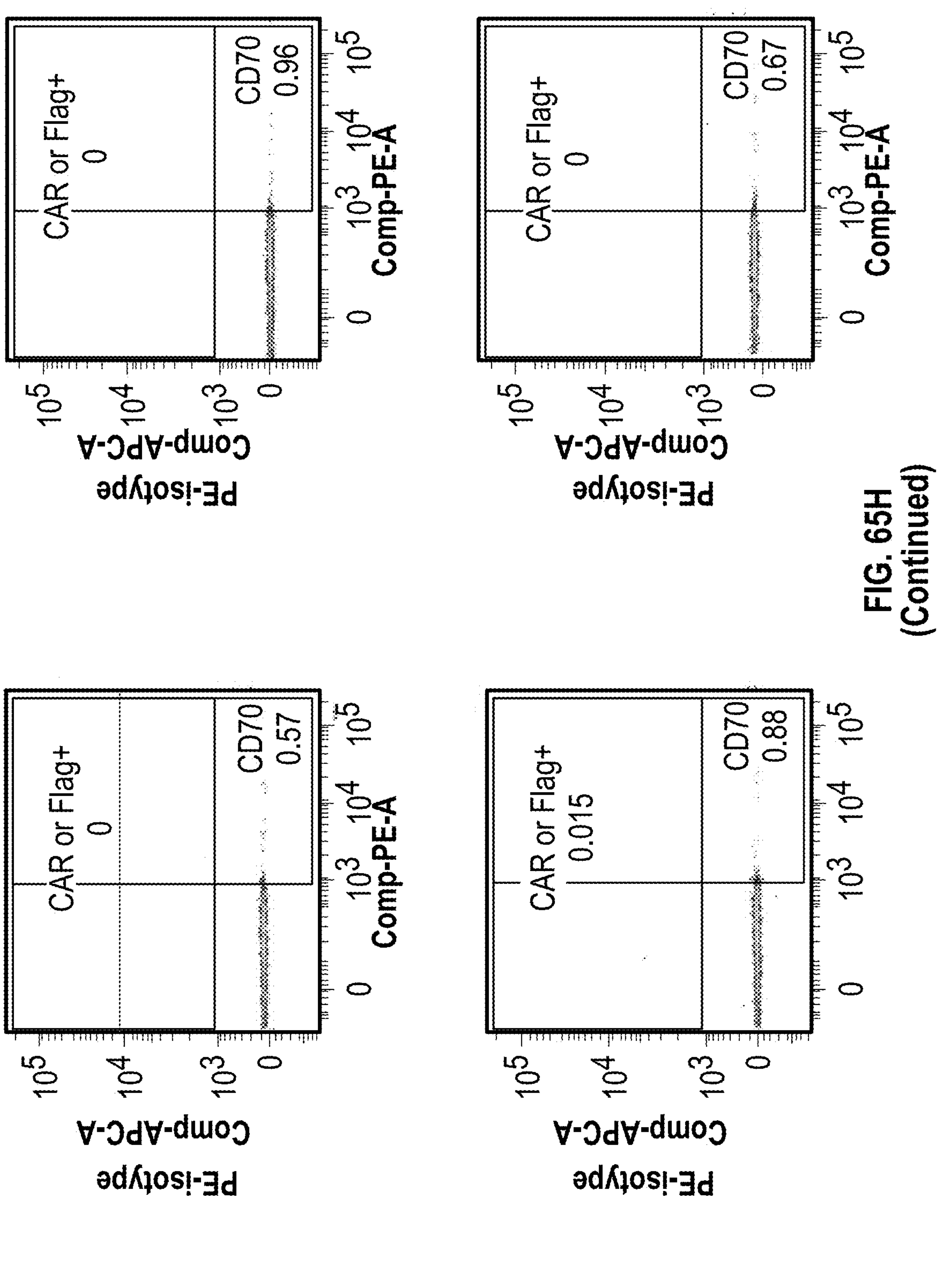
Figure 65H:
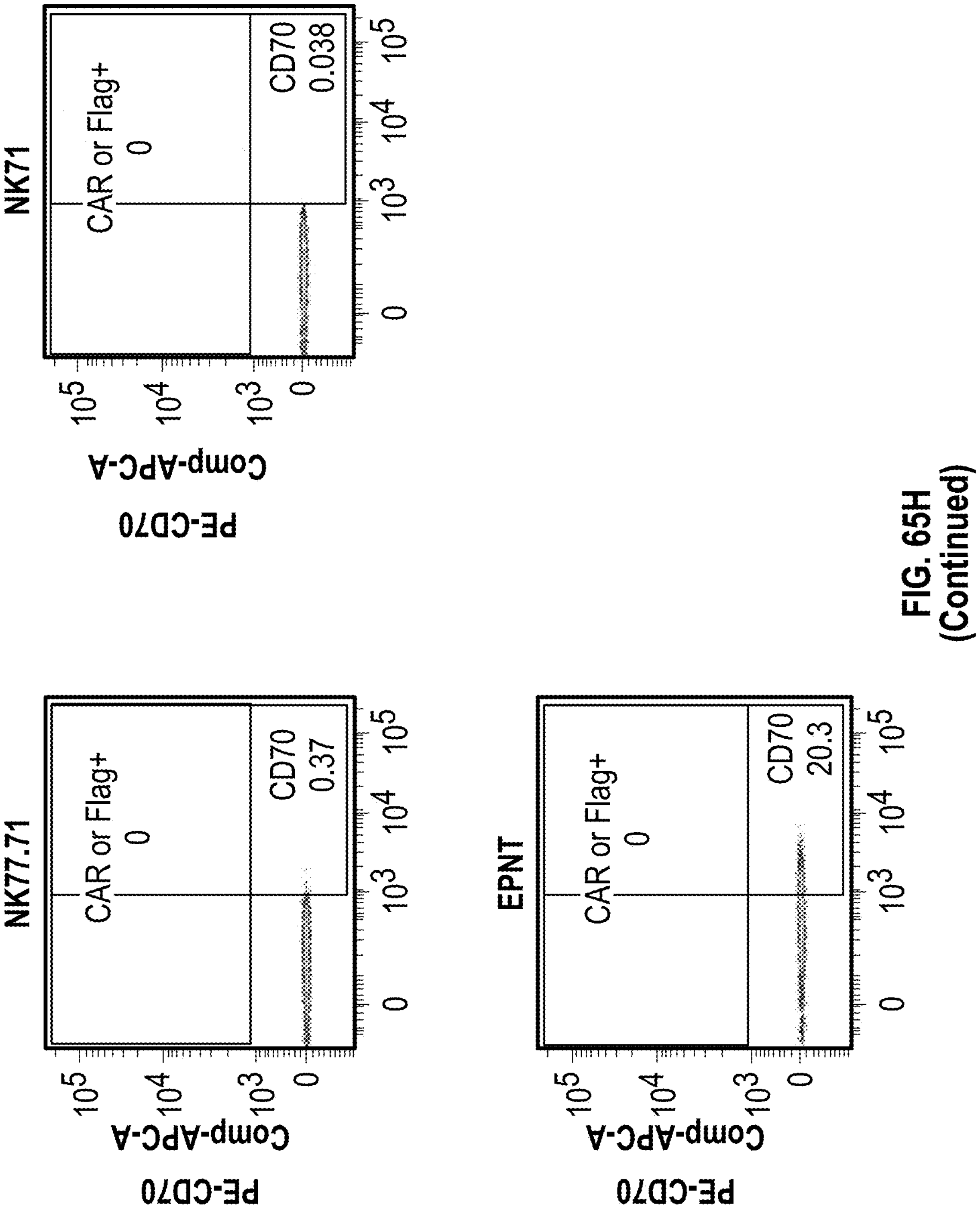
Figure 65H:
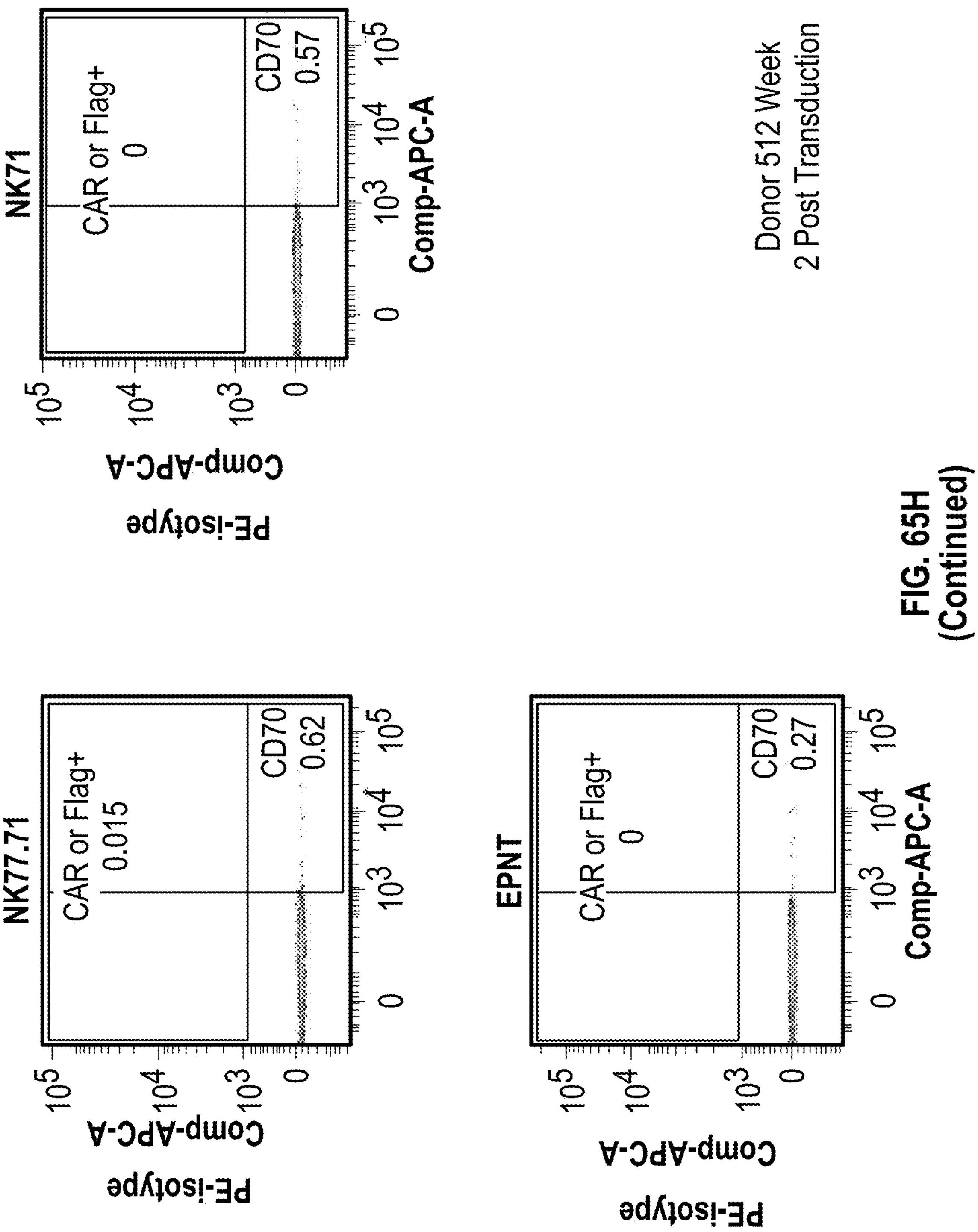

FIGS. 65A-65J show further data related to screening of various CD70 CAR constructs expressed by NK cells and characterization of CD70 gene knockout, measured at 2 weeks post-transduction of the NK cells with the CARs. FIG. 65A shows data for the indicated CD70 CAR constructs and their ability, when expressed by NK cells, to bind a native CD70 trimer. FIG. 65B shows similar data from another donor. FIGS. 65C and 65D shows summary data from the flow cytometry binding data, expressed as a percentage of the NK cell population that is binding the CD70 trimer, or as the detected mean fluorescence intensity (MFI) for the two respective donors. FIGS. 65E and 65F show graphical summary data for the relative expression of each of the indicated CAR constructs by NK cells, as measured by MFI. FIGS. 65G and 65H show flow cytometry plots depicting the maintained knockout of CD70 expression in the NK cells from each of the two donors. FIGS. 65I and 65J show summary data of the percent of NK cells expressing CD70 as a percentage and by MFI for both donors.

Figure 66A:
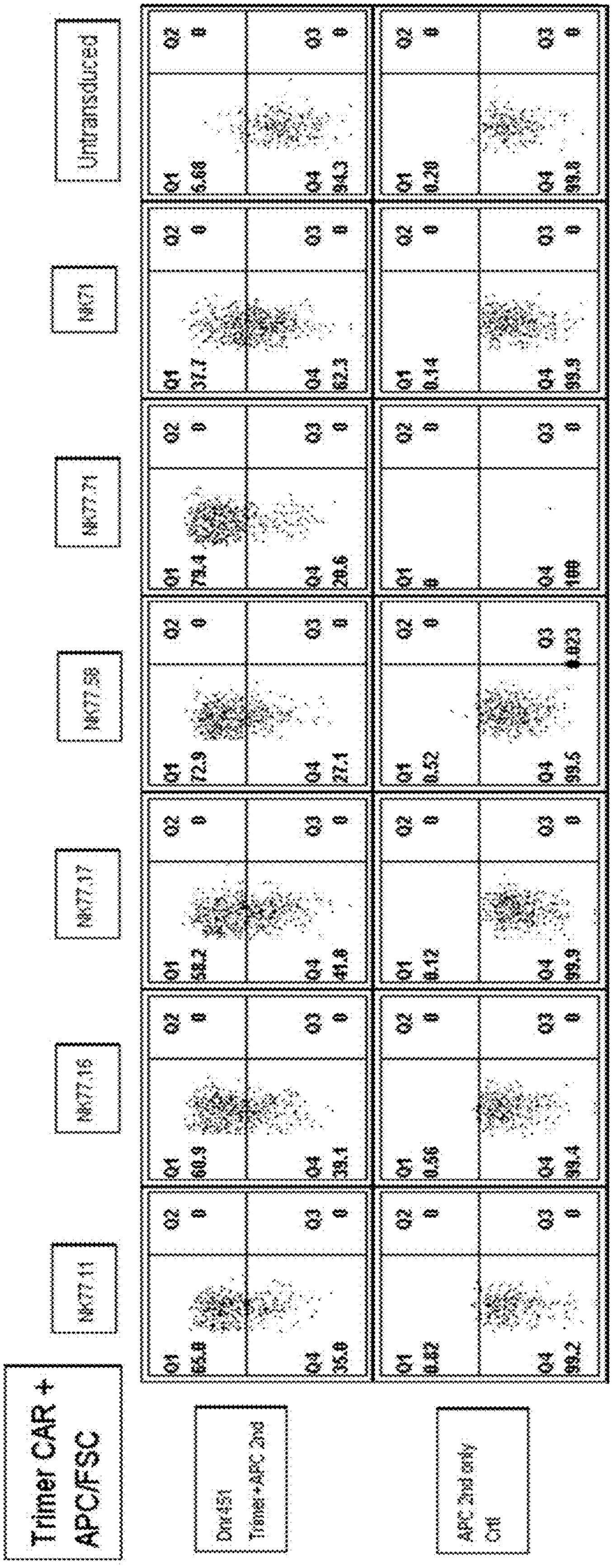
Figure 66A:
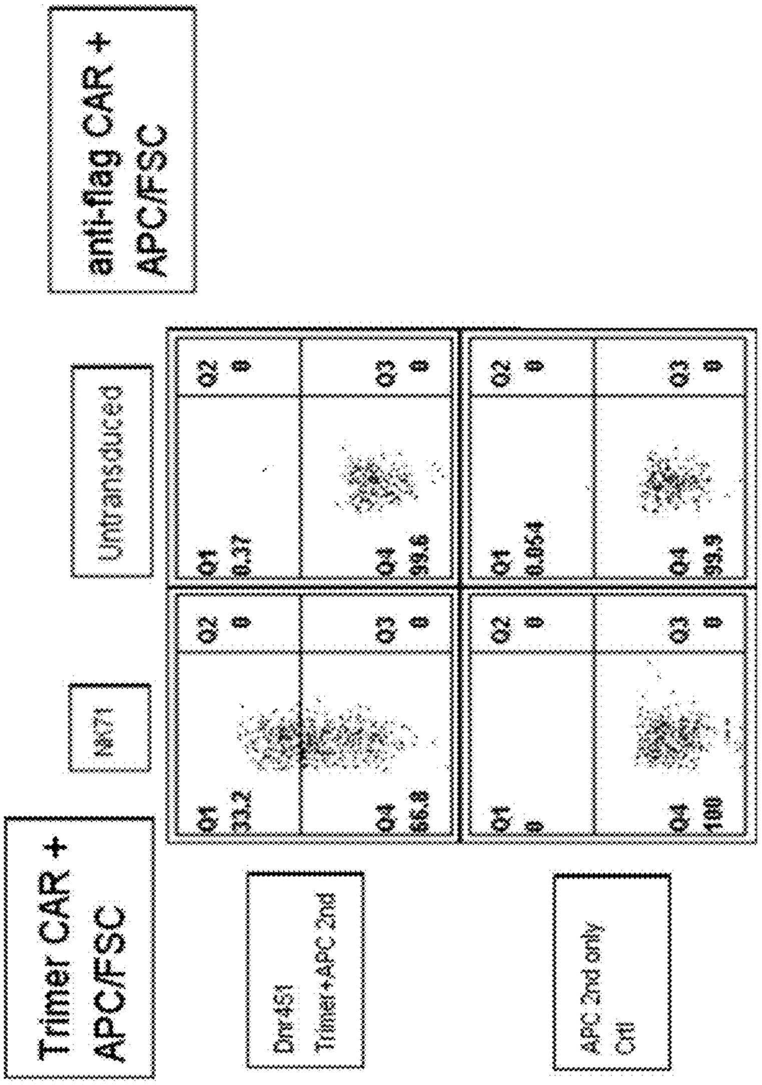
Figure 66B:
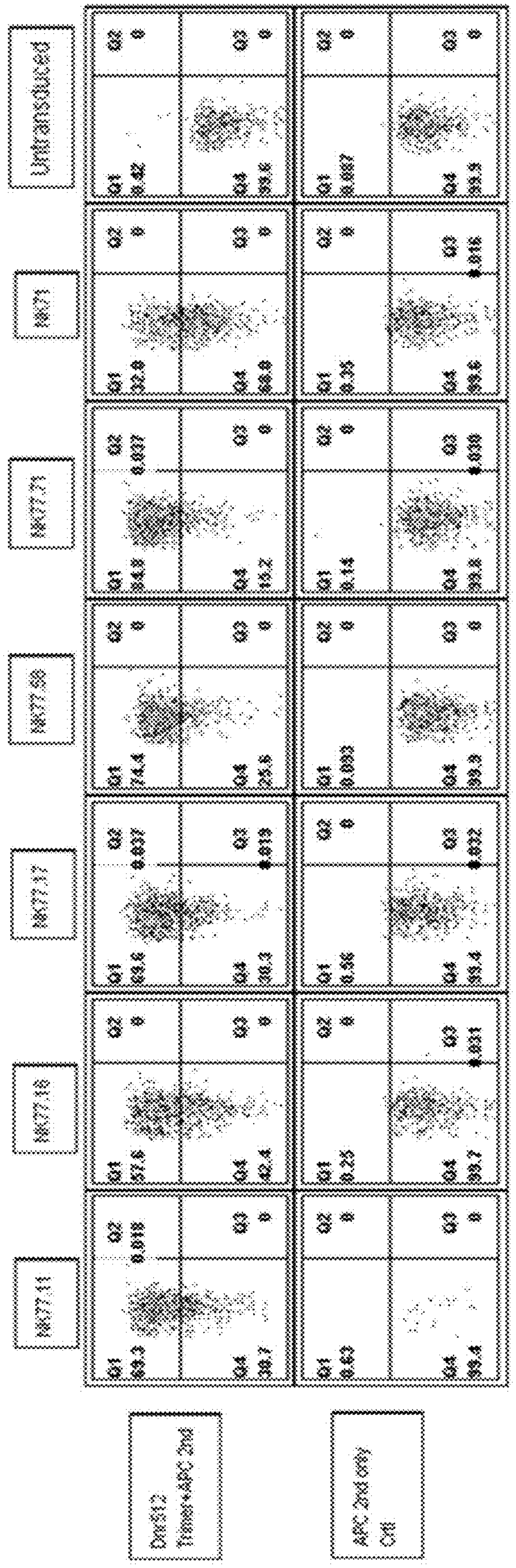
Figure 66B:
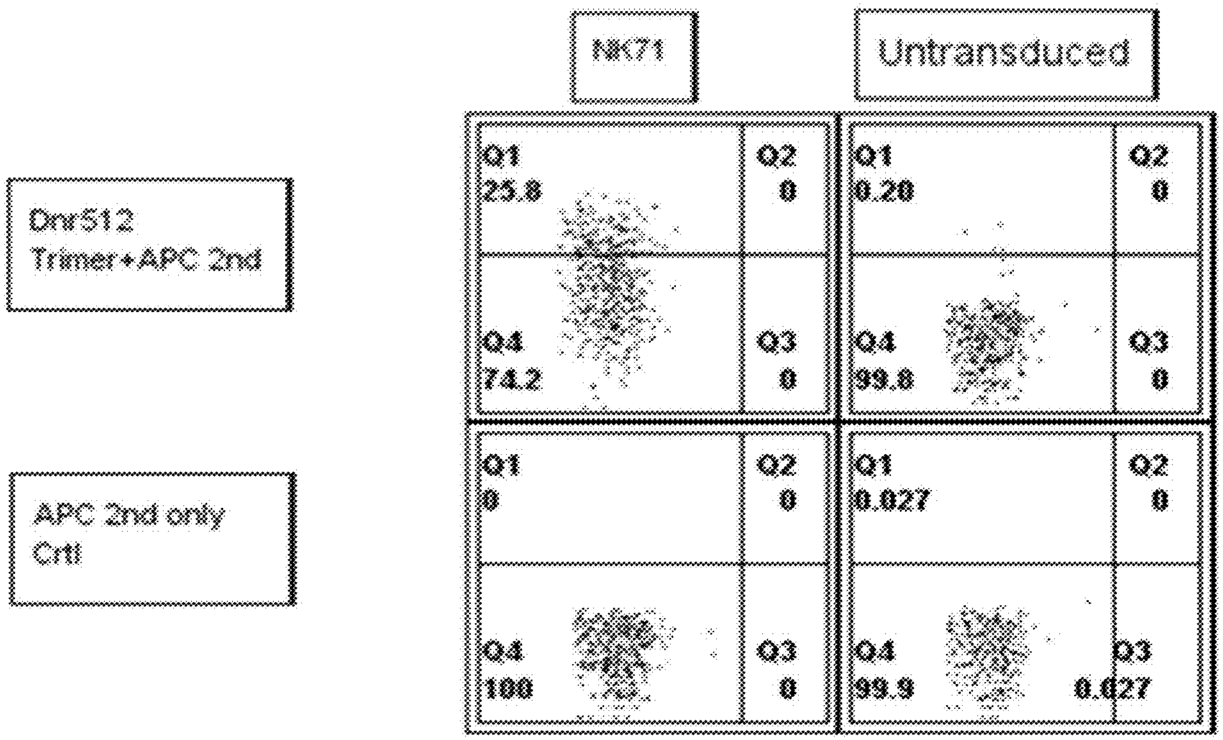
Figure 66E:
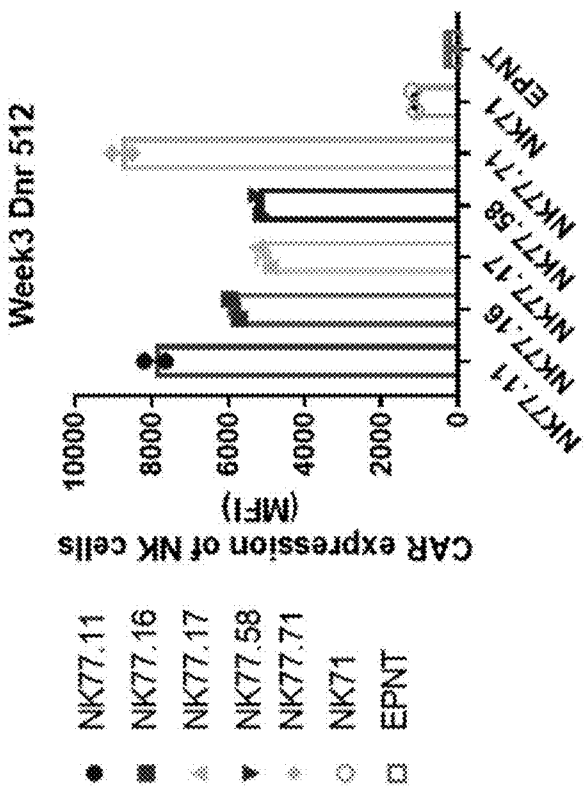
Figure 66D:
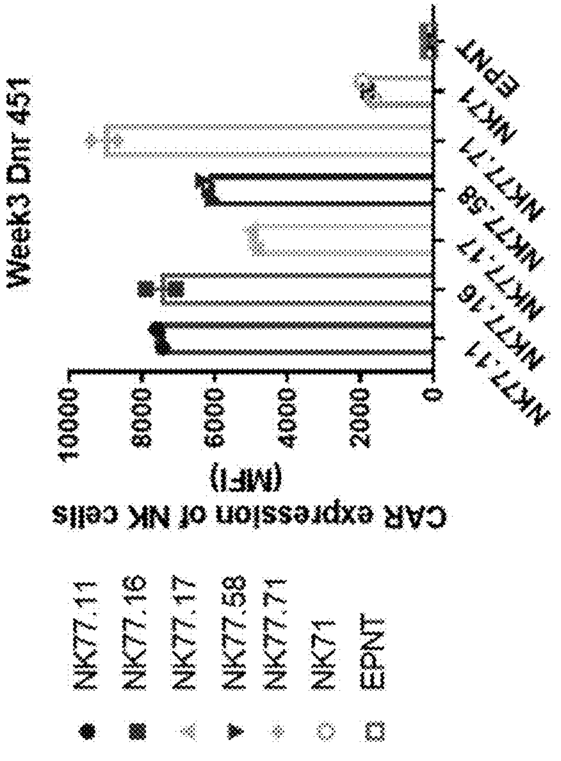
Figure 66F:
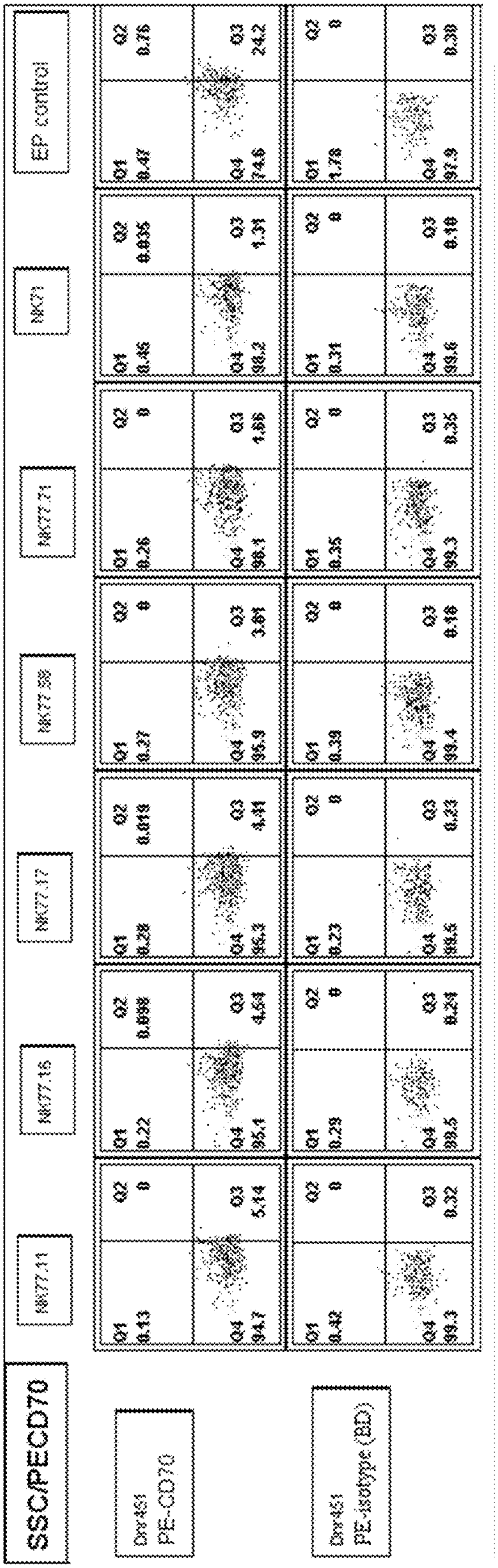
Figure 66G:
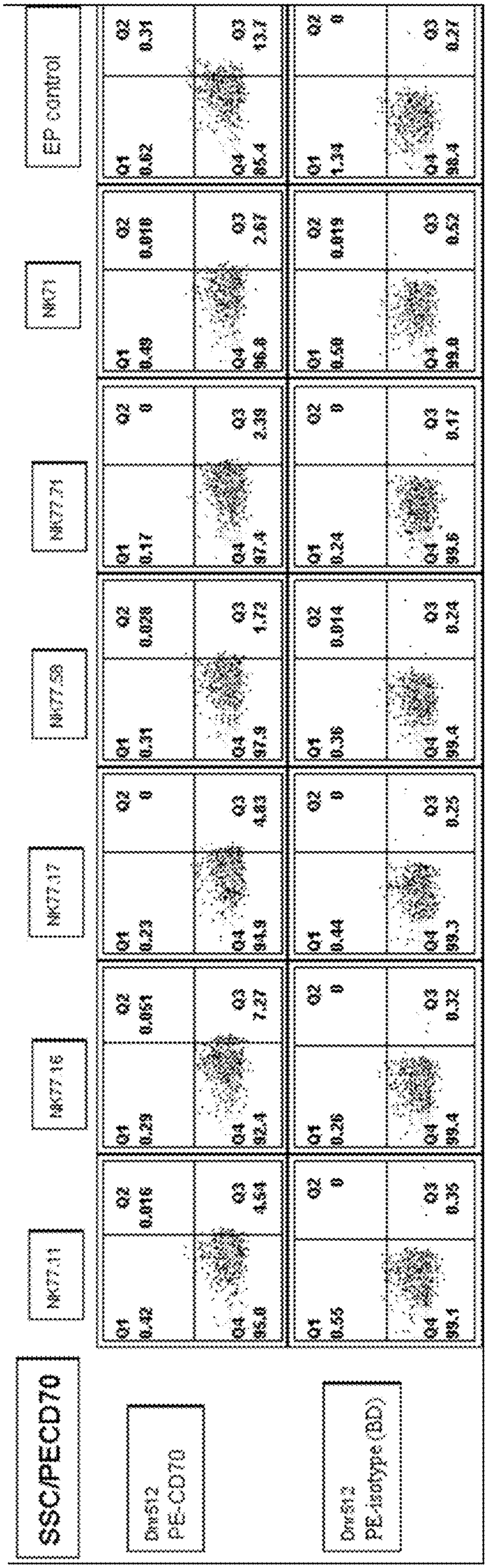

FIGS. 66A-661 show further data related to screening of various CD70 CAR constructs expressed by NK cells and characterization of CD70 gene knockout, measured at 3 weeks post-transduction of the NK cells with the CARs. FIG. 66A shows data for the indicated CD70 CAR constructs and their ability, when expressed by NK cells, to bind a native CD70 trimer. FIG. 66B shows similar data from another donor. FIG. 66C shows summary data from the flow cytometry binding data, expressed as a percentage of the NK cell population that is binding the CD70 trimer, or as the detected mean fluorescence intensity (MFI) for the two respective donors. FIGS. 66D and 66E show graphical summary data for the relative expression of each of the indicated CAR constructs by NK cells, as measured by MFI. FIGS. 66F and 66G show flow cytometry plots depicting the maintained knockout of CD70 expression in the NK cells from each of the two donors. FIGS. 66H and 661 show summary data of the percent of NK cells expressing CD70 as a percentage and by MFI, as well a percent viability, for both donors.

Figure 67A:
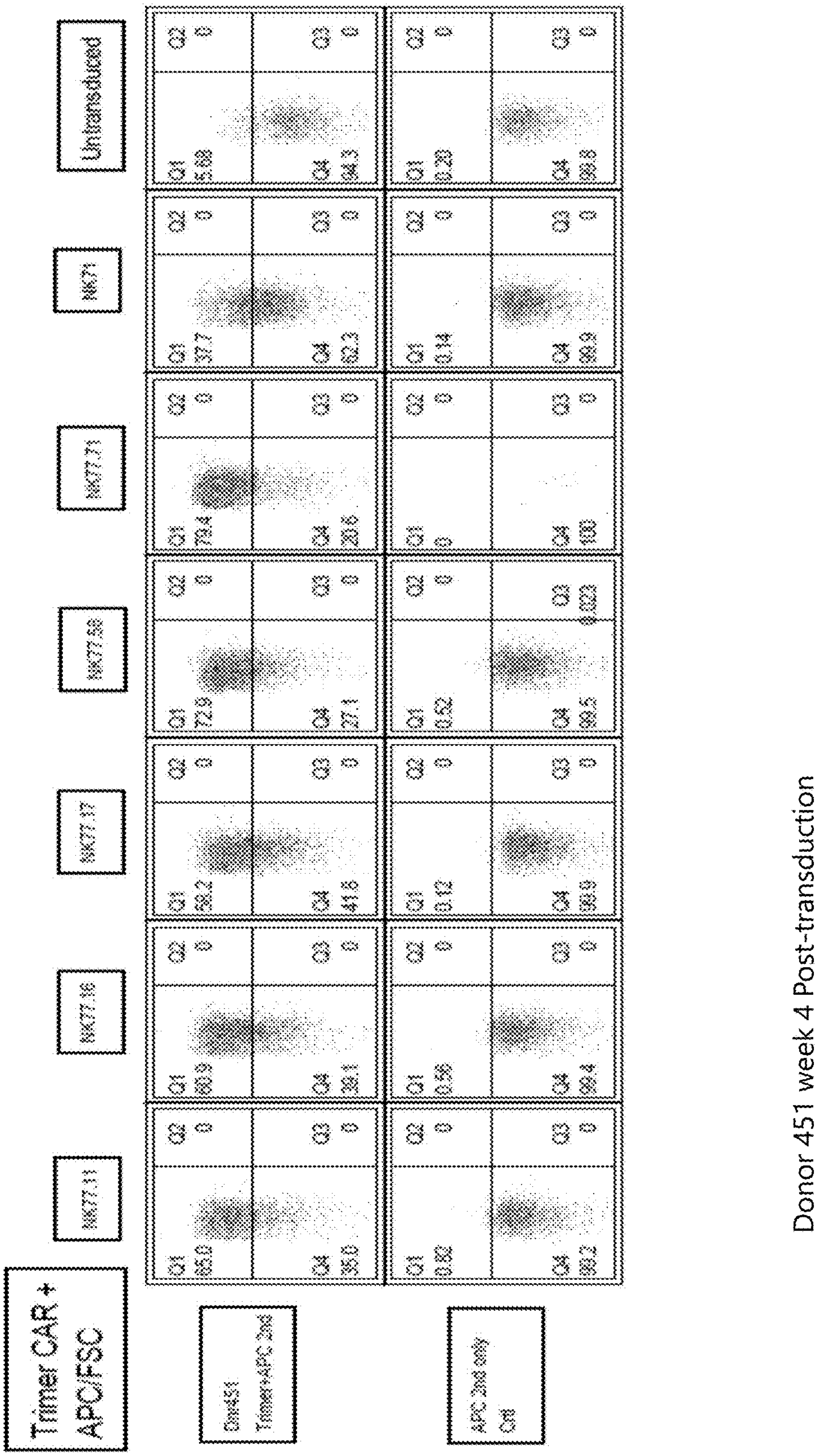
Figure 67A:
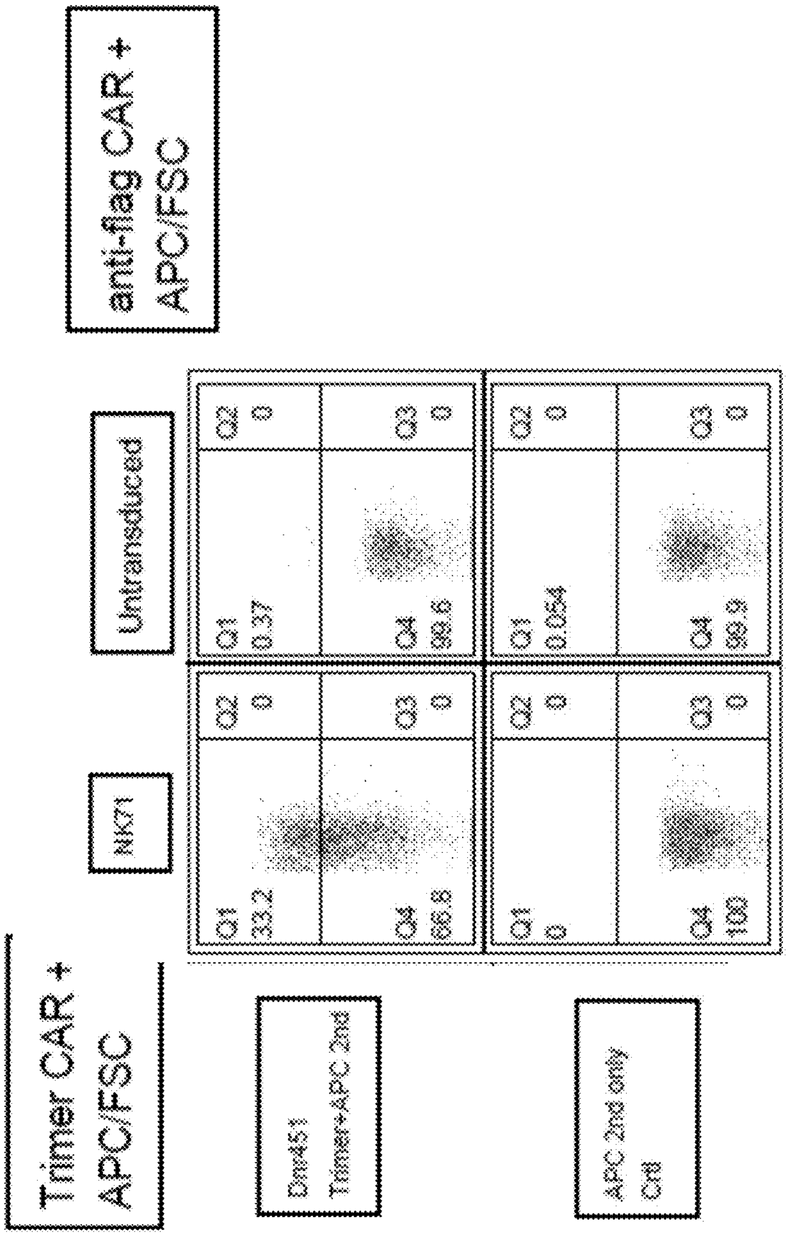
Figure 67B:
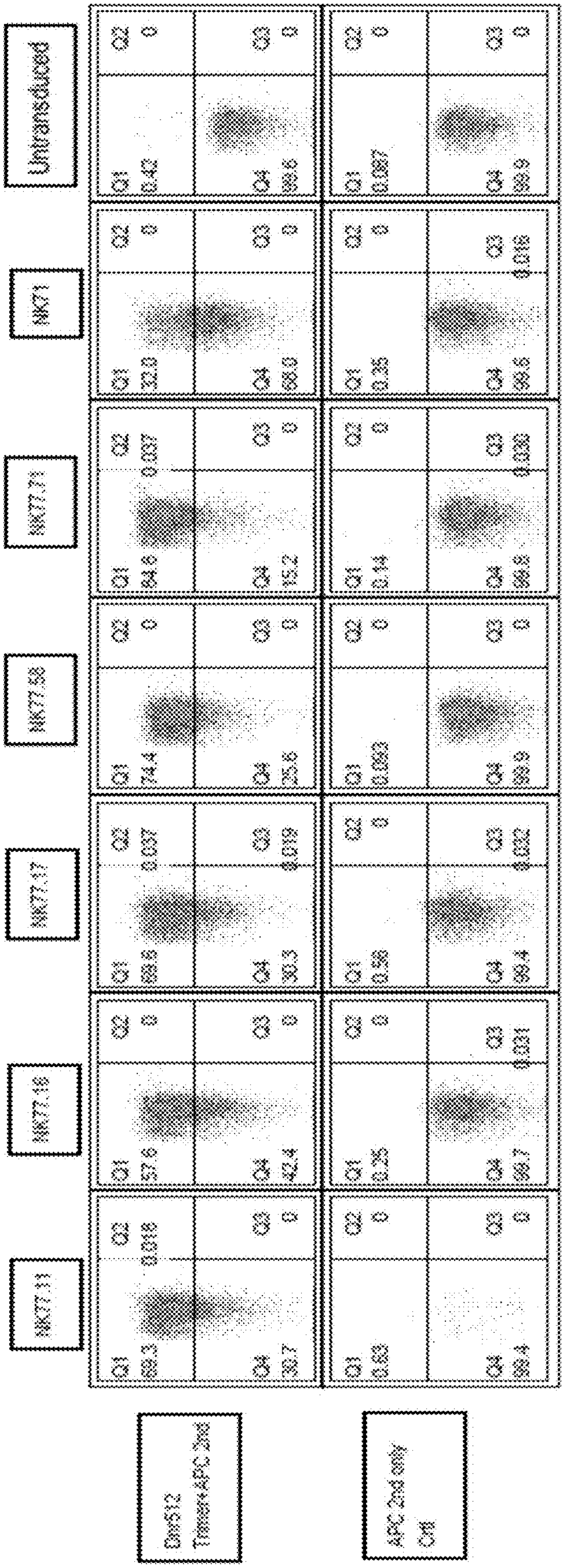
Figure 67B:
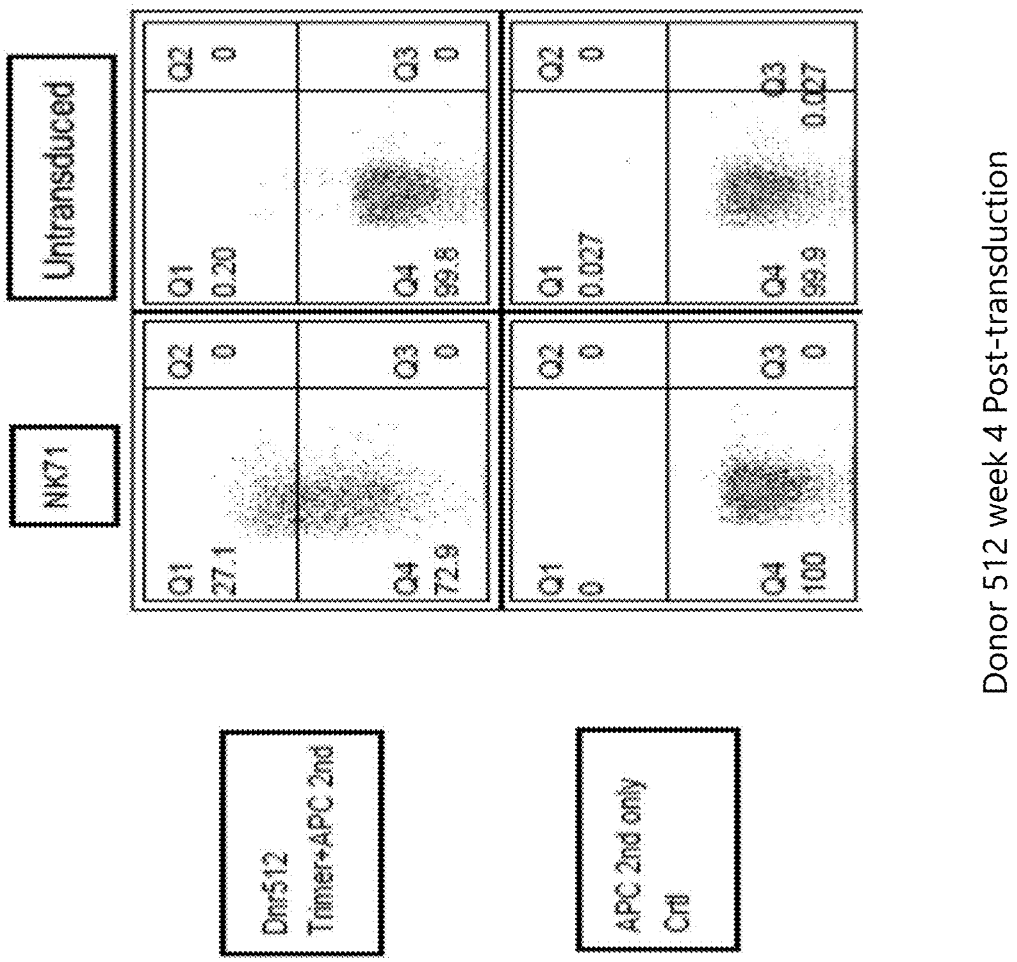
Figure 67F:
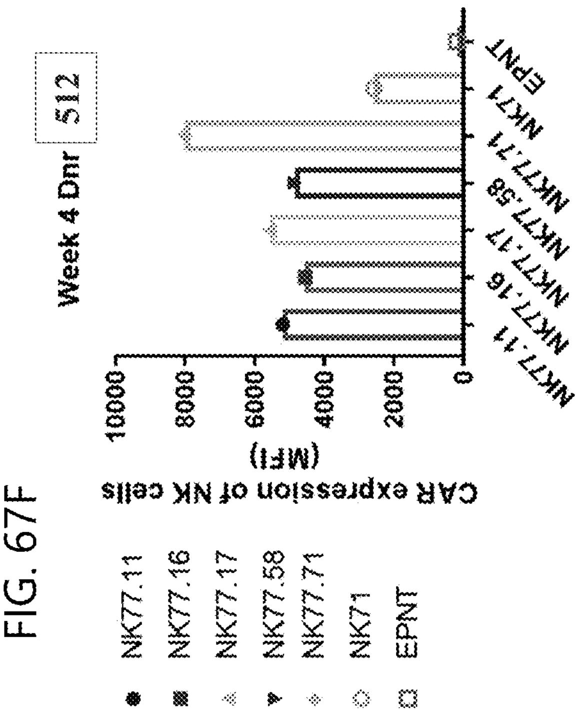
Figure 67E:
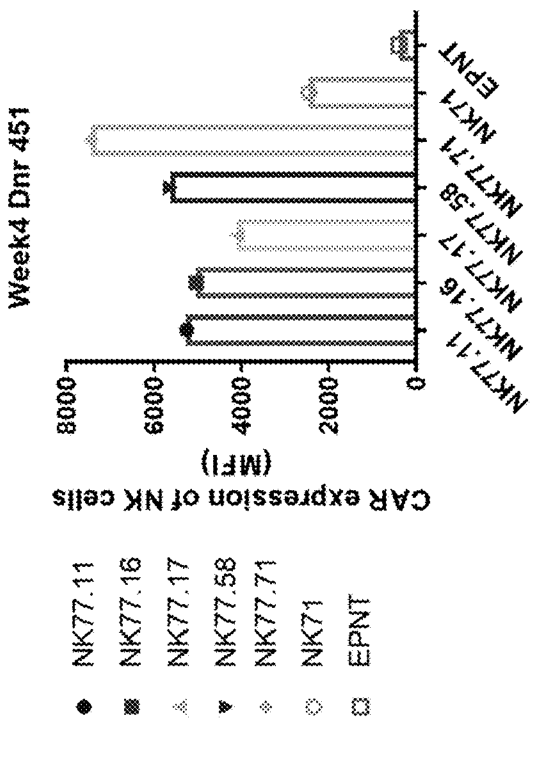
Figure 67G:
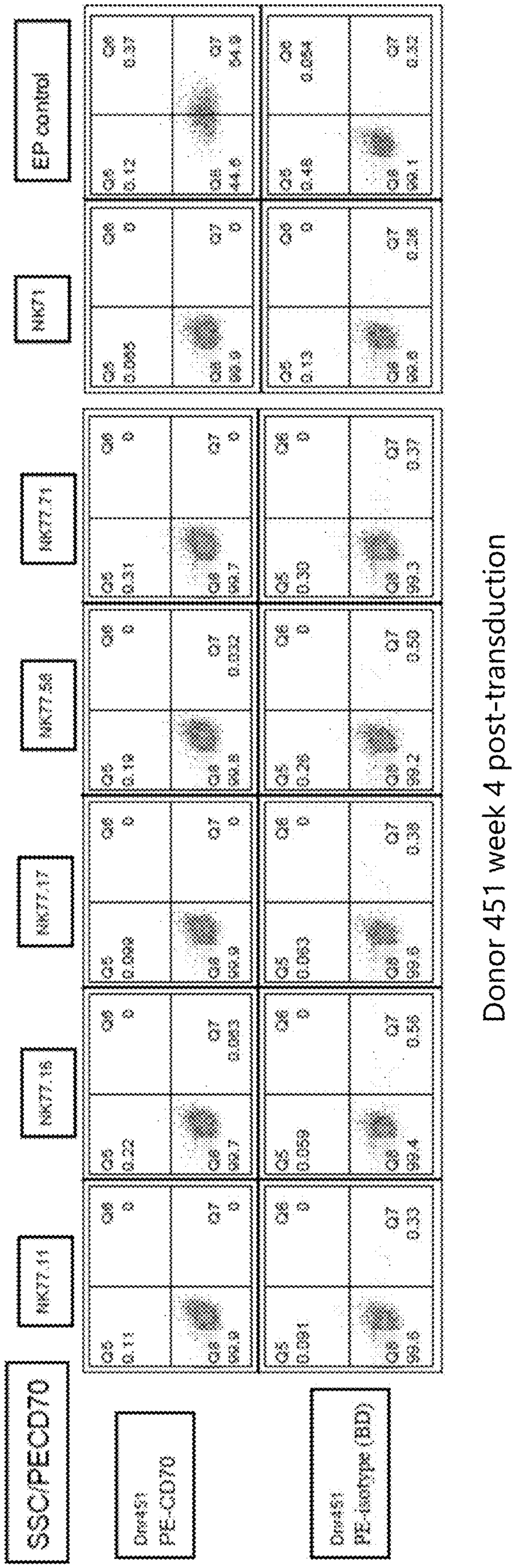
Figure 67H:
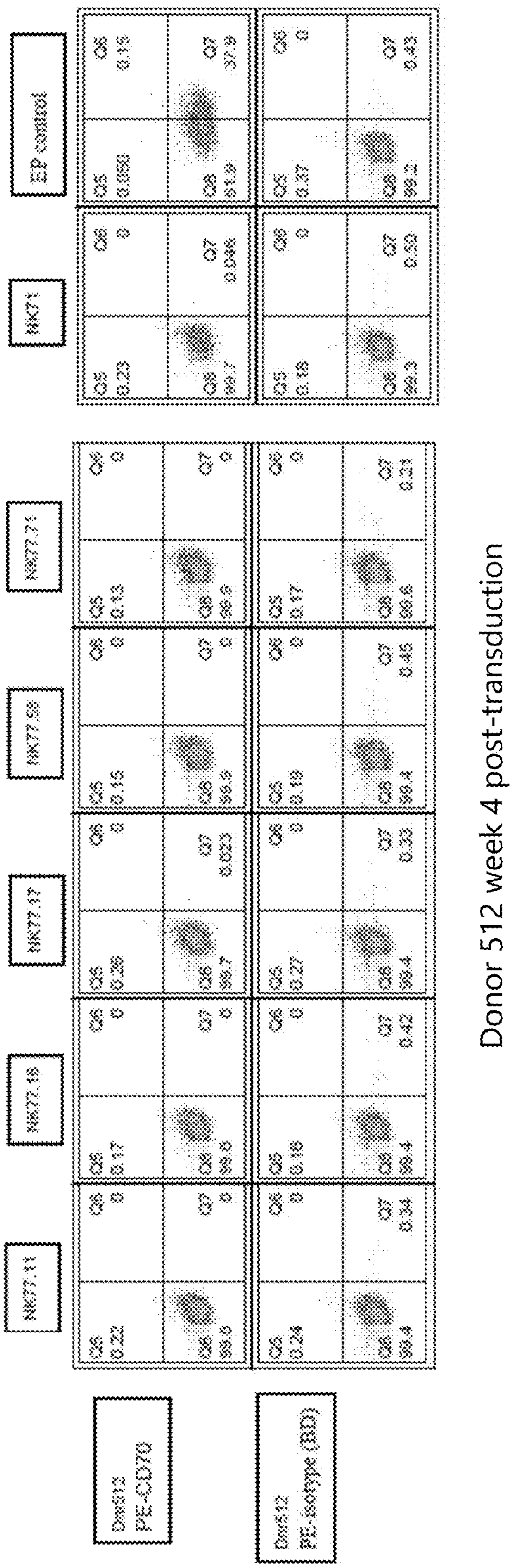

FIGS. 67A-67J show further data related to screening of various CD70 CAR constructs expressed by NK cells and characterization of CD70 gene knockout, measured at 4 weeks post-transduction of the NK cells with the CARs. FIG. 67A shows data for the indicated CD70 CAR constructs and their ability, when expressed by NK cells, to bind a native CD70 trimer. FIG. 67B shows similar data from another donor. FIGS. 67C and 67D shows summary data from the flow cytometry binding data, expressed as a percentage of the NK cell population that is binding the CD70 trimer, or as the detected mean fluorescence intensity (MFI) for the two respective donors. FIGS. 67E and 67F show graphical summary data for the relative expression of each of the indicated CAR constructs by NK cells, as measured by MFI. FIGS. 67G and 67H show flow cytometry plots depicting the maintained knockout of CD70 expression in the NK cells from each of the two donors. FIGS. 67I and 67J show summary data of the percent of NK cells expressing CD70 as a percentage and by MFI for both donors.

Figure 68A:
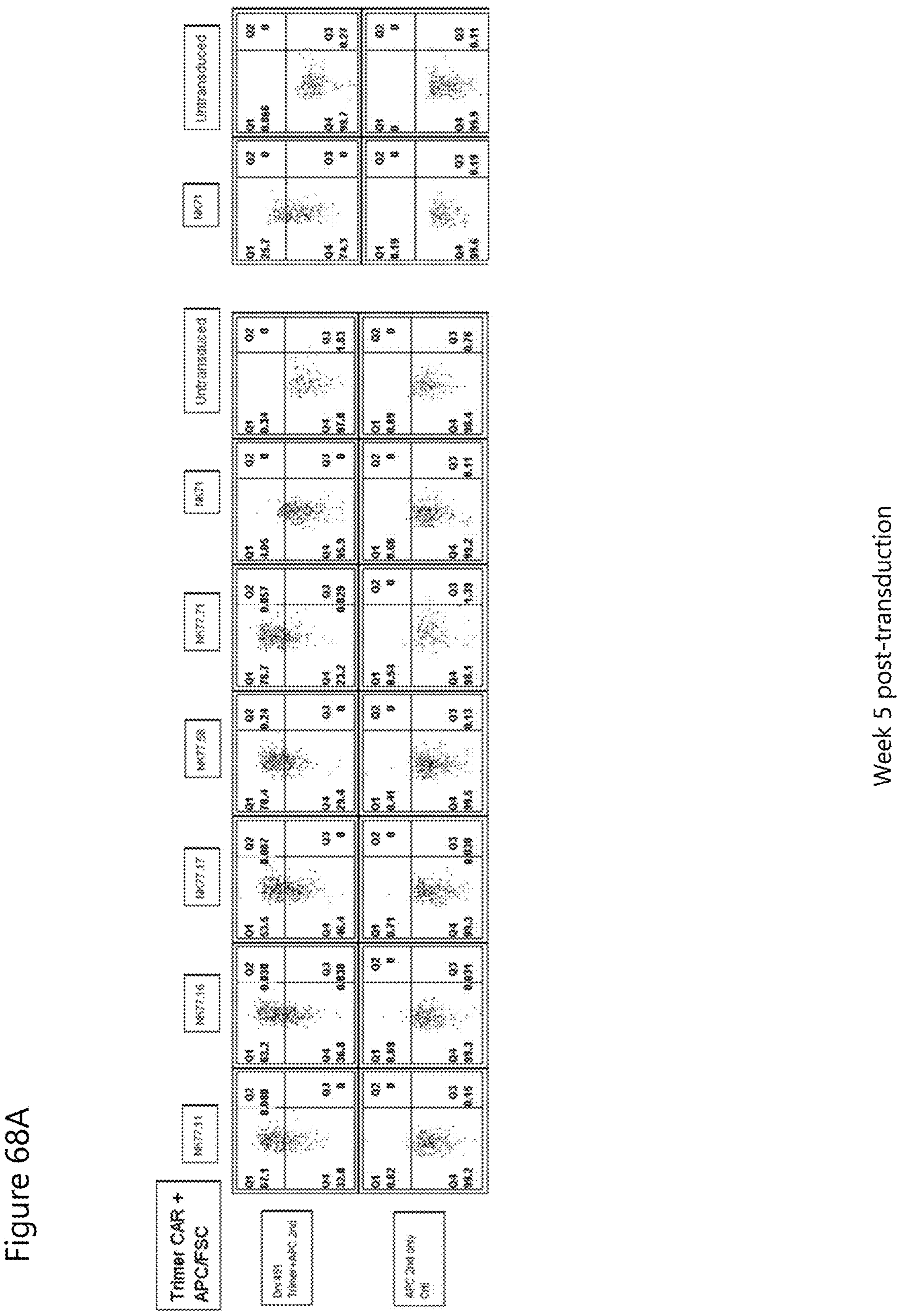
Figure 68B:
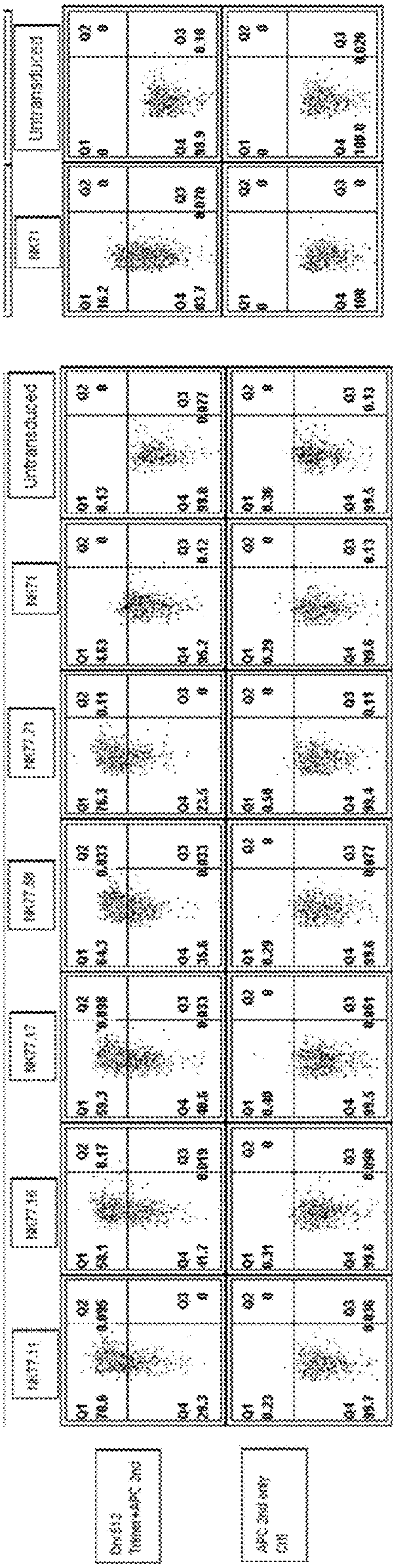
Figure 68E:
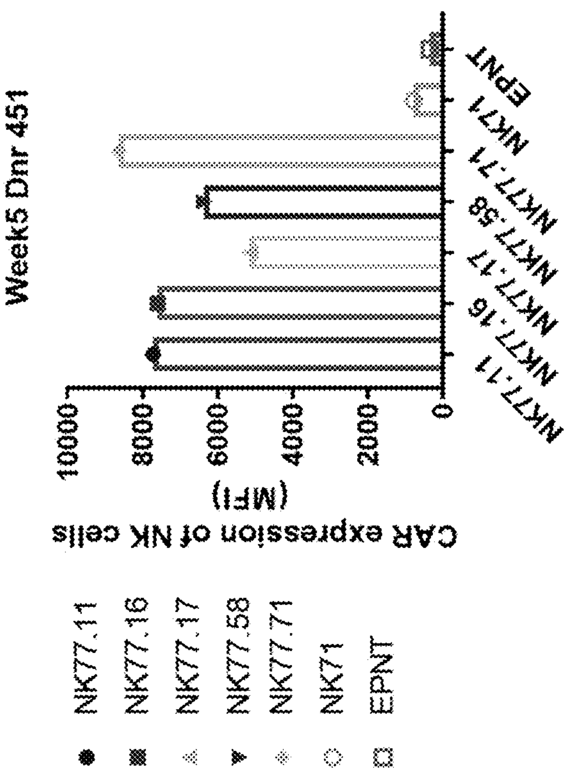
Figure 68F:
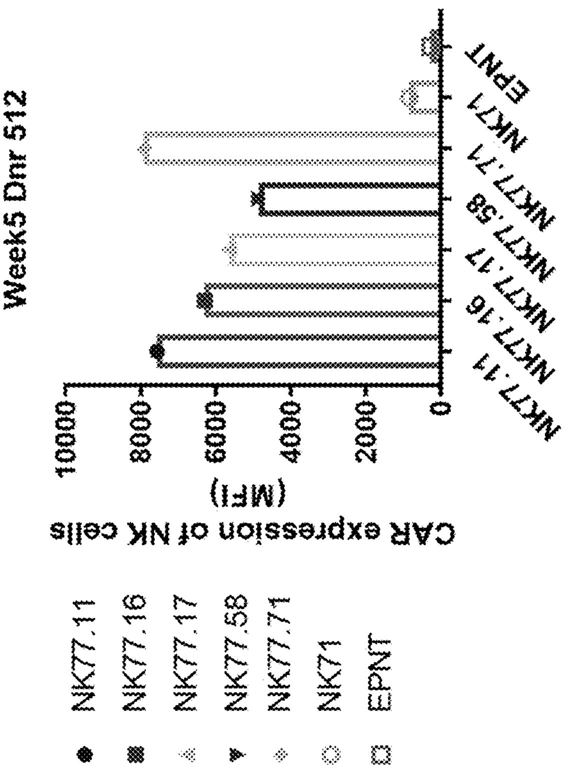
Figure 68G:
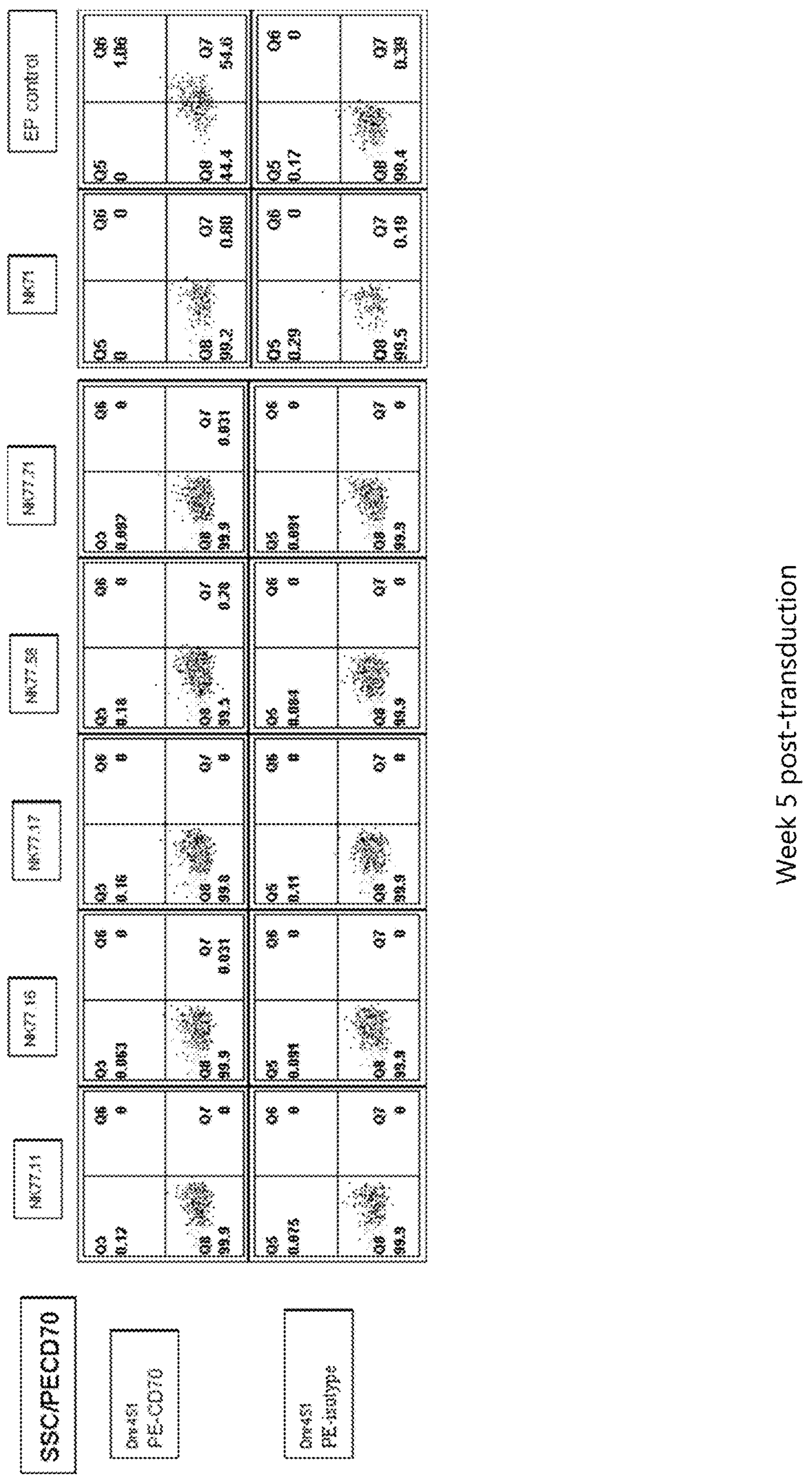
Figure 68H:
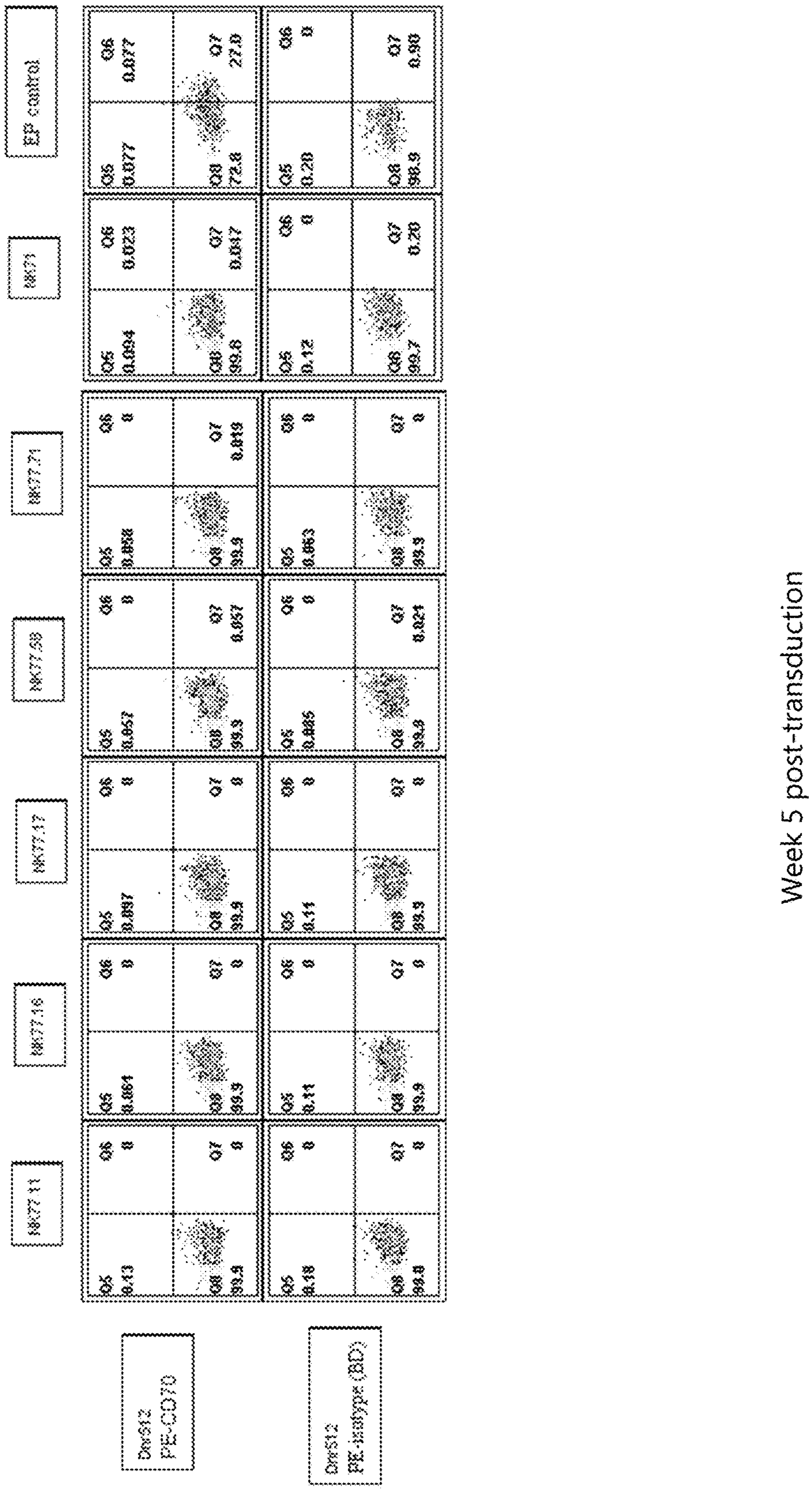

FIGS. 68A-68I show further data related to screening of various CD70 CAR constructs expressed by NK cells and characterization of CD70 gene knockout, measured at 5 weeks post-transduction of the NK cells with the CARs. FIG. 68A shows data for the indicated CD70 CAR constructs and their ability, when expressed by NK cells, to bind a native CD70 trimer. FIG. 68B shows similar data from another donor. FIGS. 68C and 65D shows summary data from the flow cytometry binding data, expressed as a percentage of the NK cell population that is binding the CD70 trimer, or as the detected mean fluorescence intensity (MFI) for the two respective donors. FIGS. 68E and 68F show graphical summary data for the relative expression of each of the indicated CAR constructs by NK cells, as measured by MFI. FIGS. 68G and 68H show flow cytometry plots depicting the maintained knockout of CD70 expression in the NK cells from each of the two donors. FIG. 68I shows summary data of the percent of NK cells expressing CD70 as a percentage and by MFI for both donors.

Figure 69A:
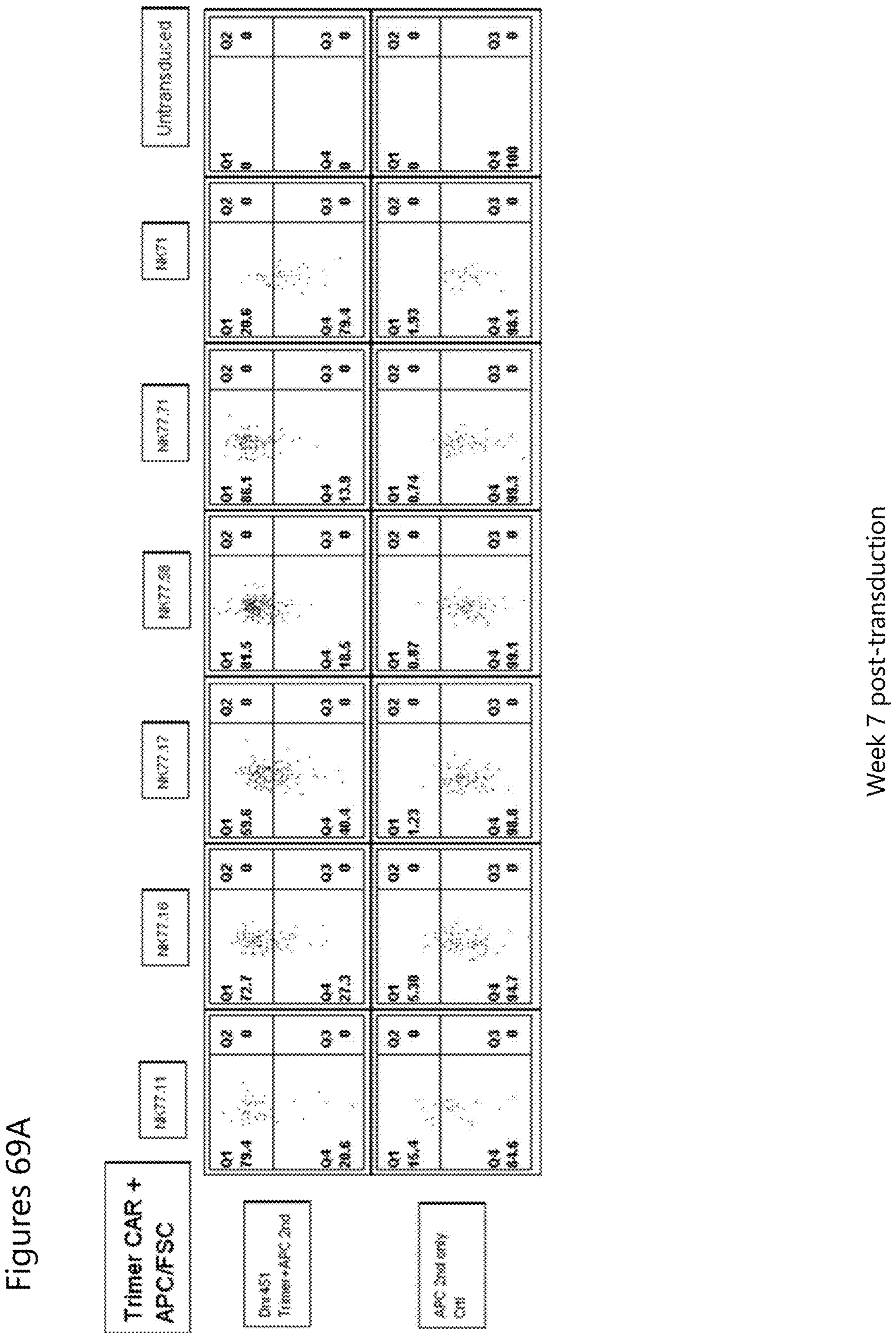
Figure 69B:
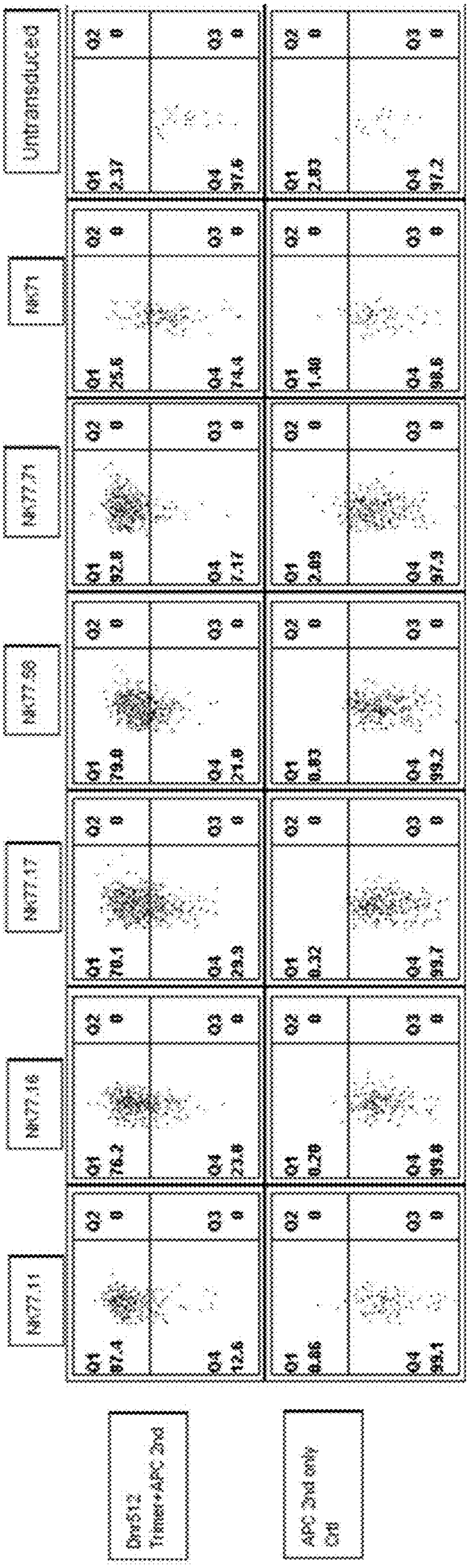
Figure 69F:
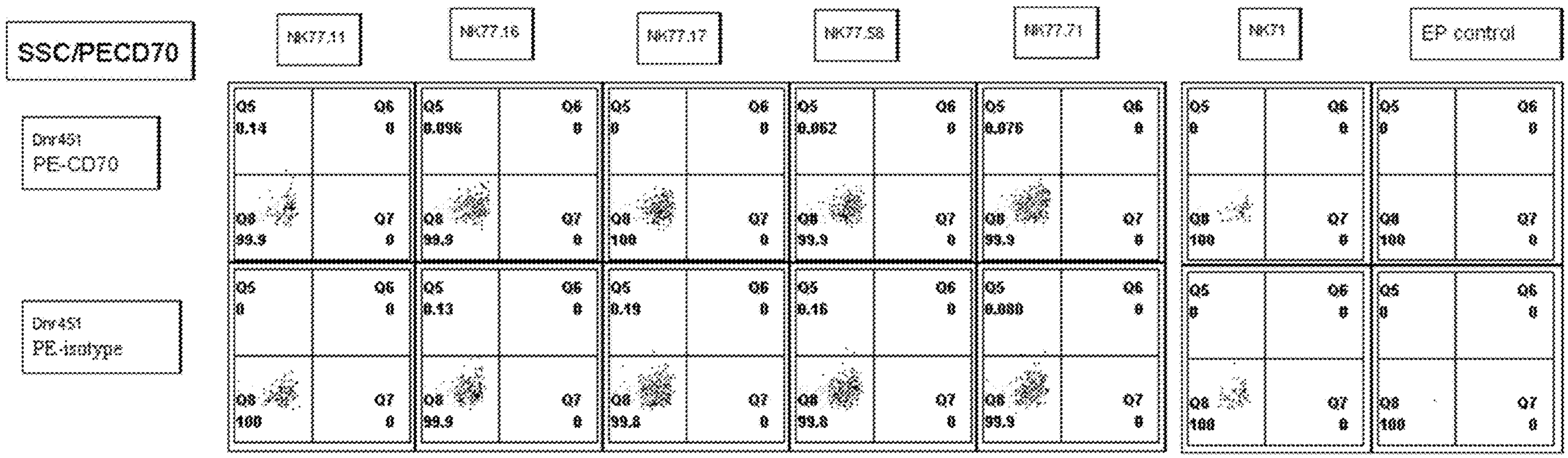
Figure 69G:
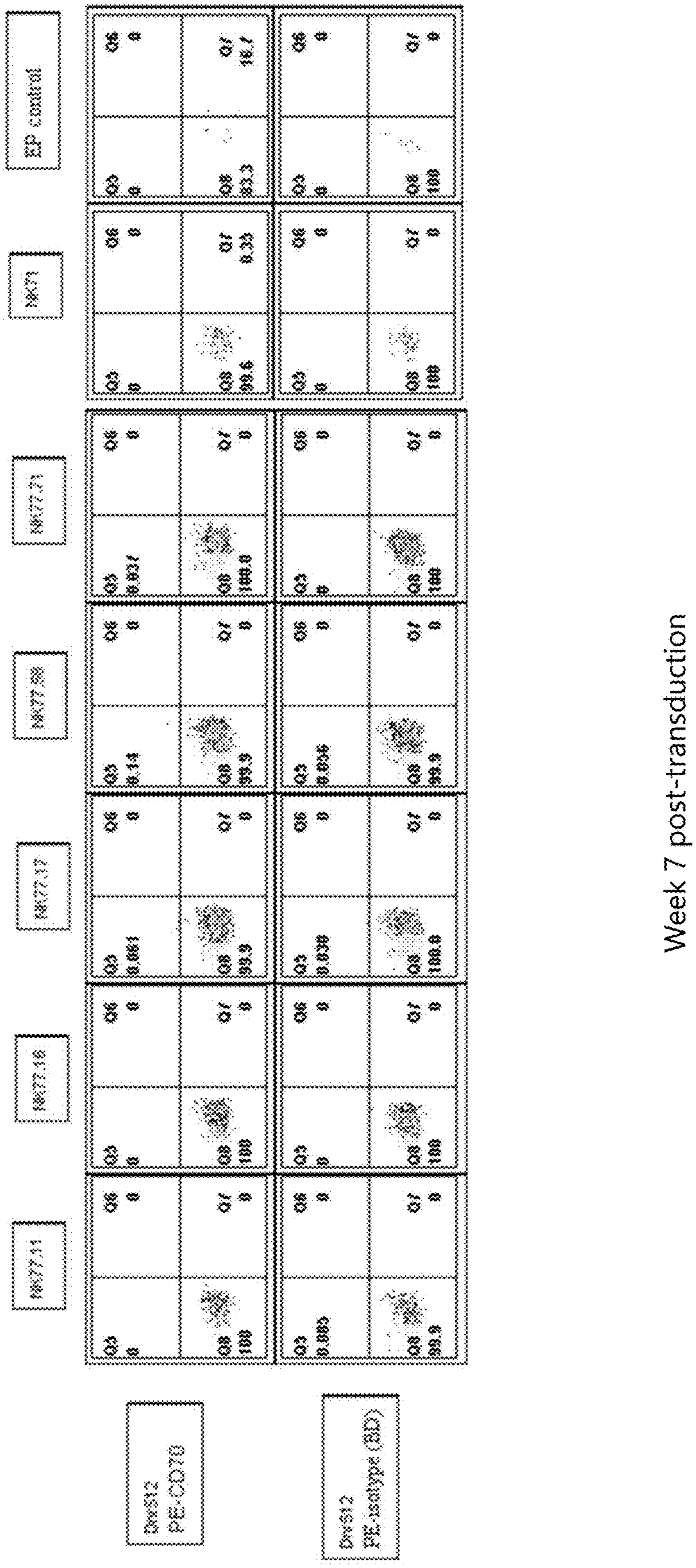

FIGS. 69A-69H show further data related to screening of various CD70 CAR constructs expressed by NK cells and characterization of CD70 gene knockout, measured at 7 weeks post-transduction of the NK cells with the CARs. FIG. 69A shows data for the indicated CD70 CAR constructs and their ability, when expressed by NK cells, to bind a native CD70 trimer and FIG. 68B shows corresponding data from another donor. FIG. 69C shows summary data from the flow cytometry binding data, expressed as a percentage of the NK cell population that is binding the CD70 trimer, or as the detected mean fluorescence intensity (MFI) for the two respective donors. FIGS. 69D and 69E show graphical summary data for the relative expression of each of the indicated CAR constructs by NK cells, as measured by MFI. FIGS. 69F and 69G show flow cytometry plots depicting the maintained knockout of CD70 expression in the NK cells from each of the two donors. FIG. 69H shows summary data of the percent of NK cells expressing CD70 as a percentage and by MFI for both donors.

Figure 70A:
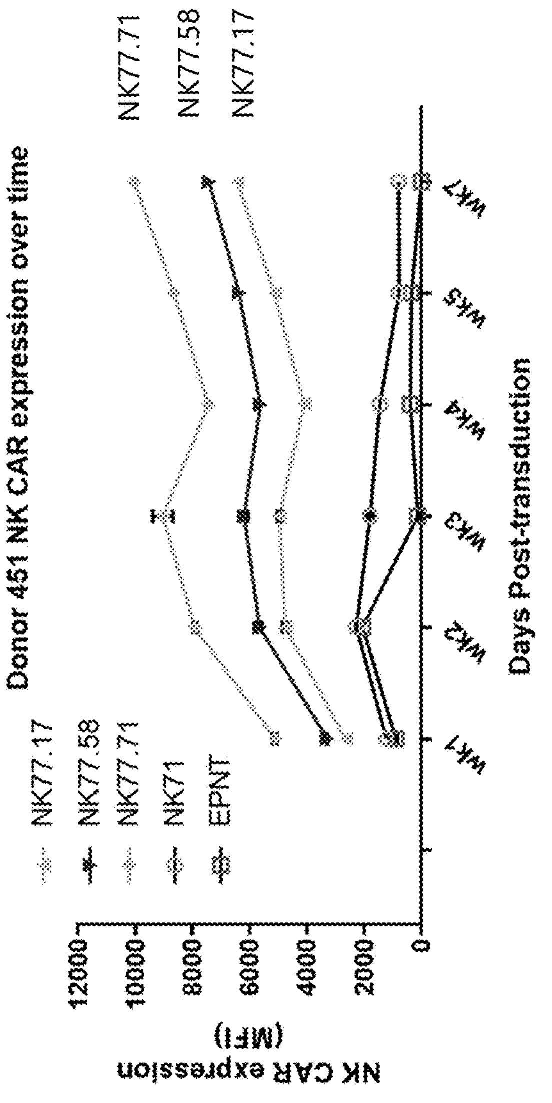
Figure 70B:
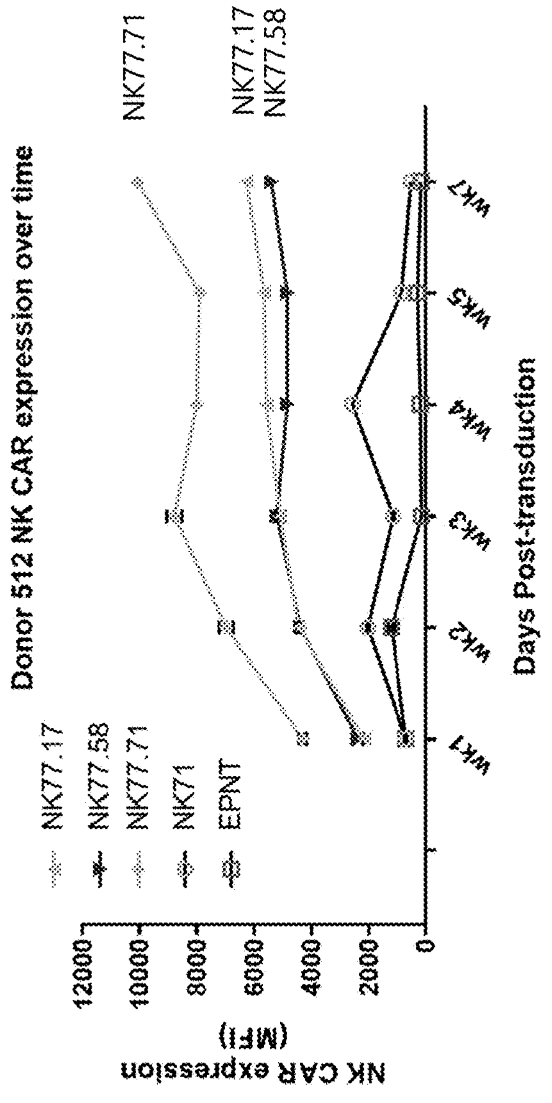

FIGS. 70A-70B show data related to the expression of selected non-limiting anti-CD70 CARs by NK cells over time. FIG. 70A tracks the expression of three non-limiting CARs on NK cells from a first donor and FIG. 70B tracks expression of the same CARs on NK cells from a second donor.

Figure 71B:
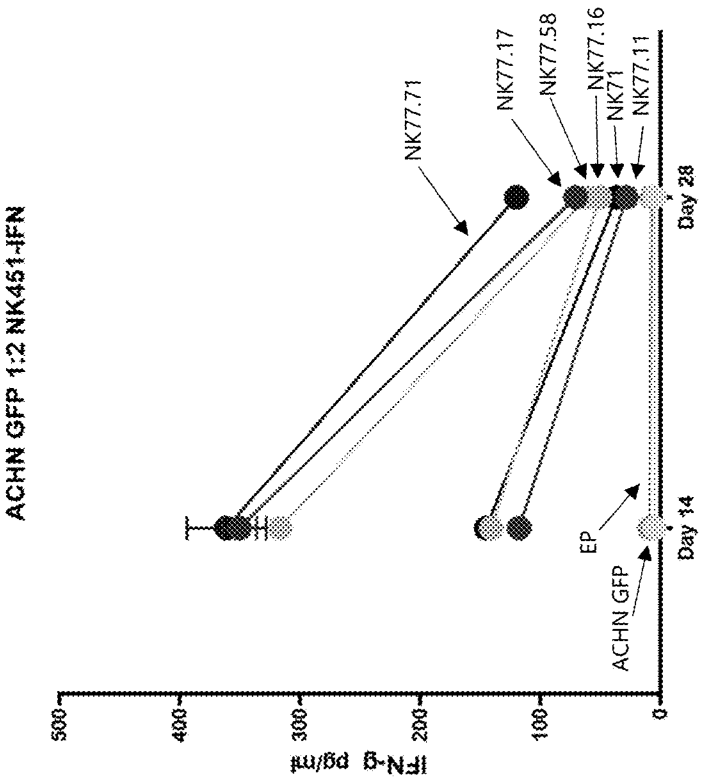
Figure 71A:
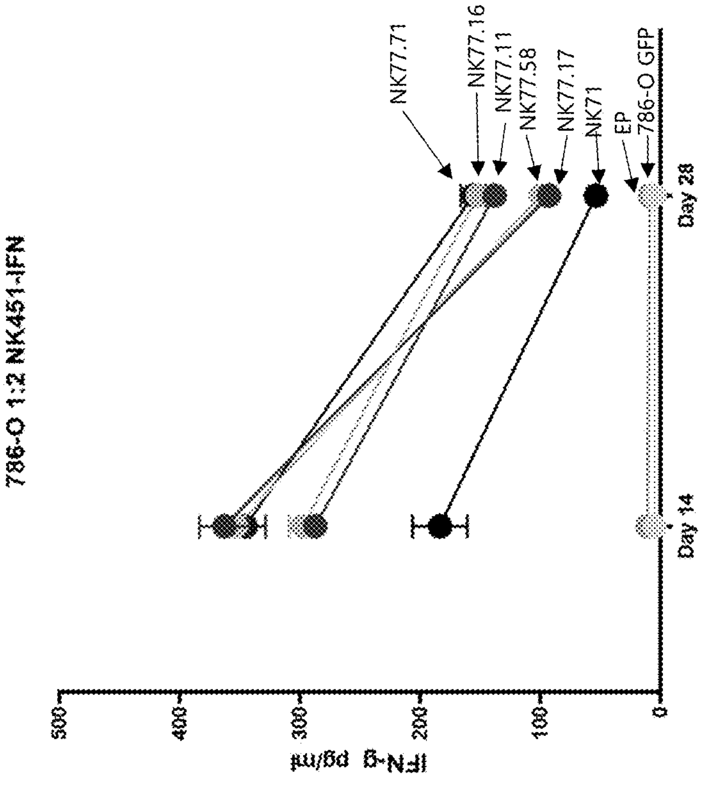
Figure 71D:
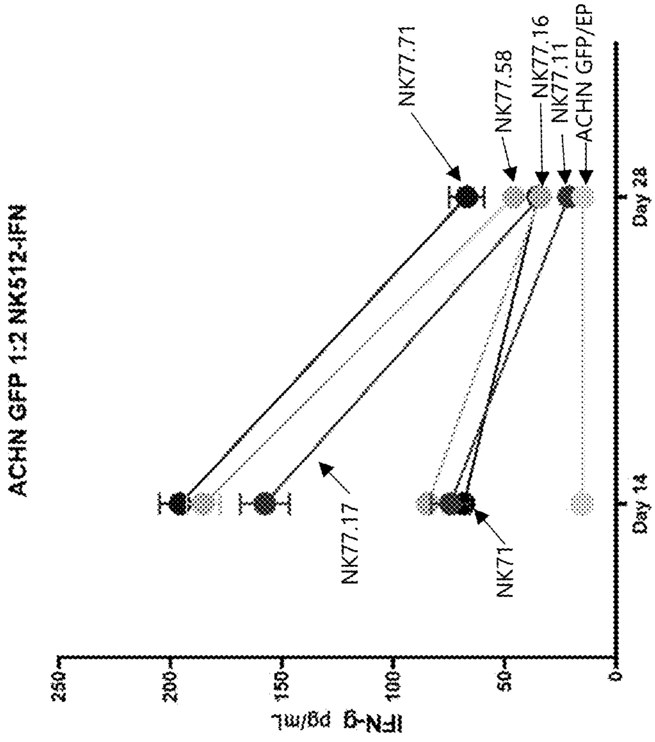
Figure 71C:
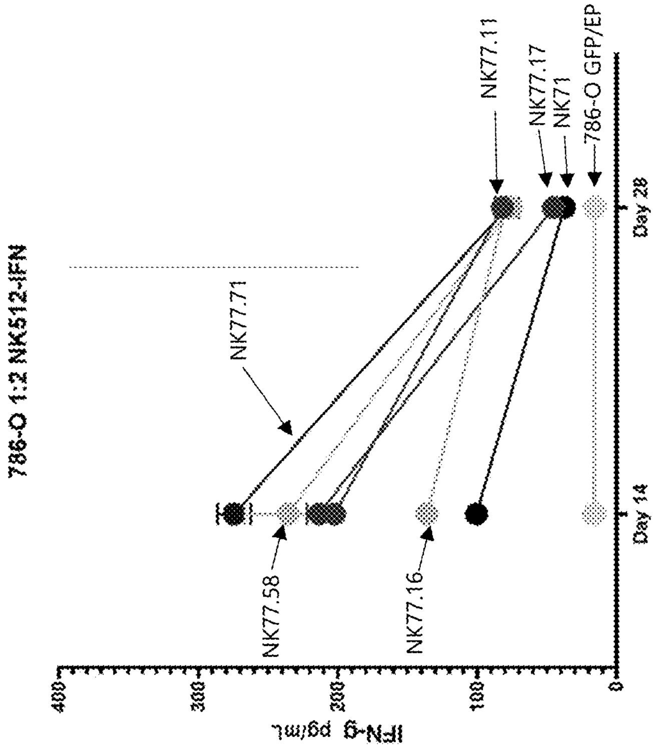
Figure 71F:
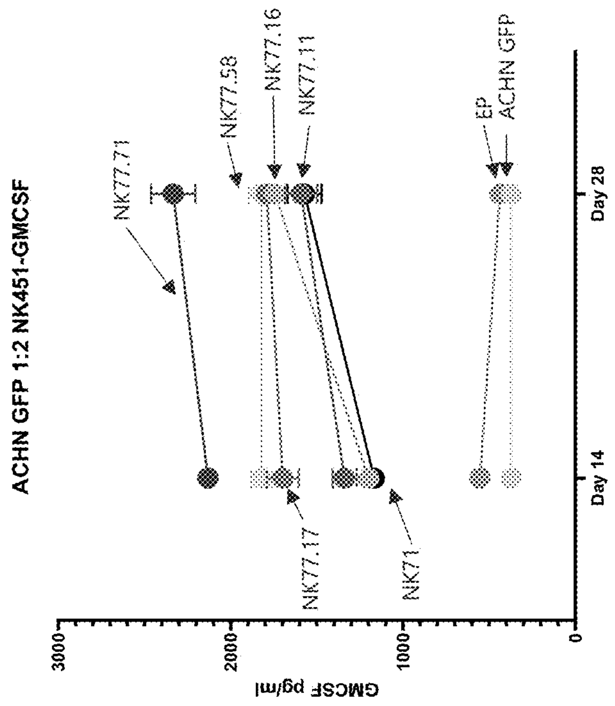
Figure 71E:
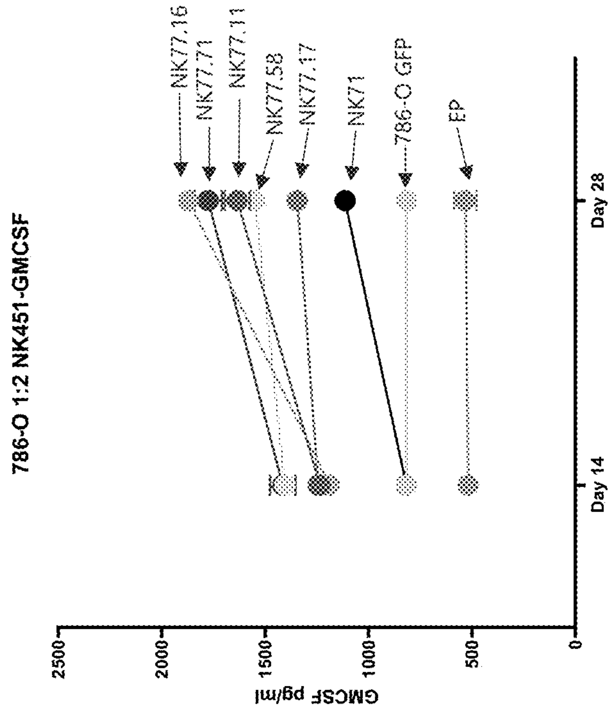
Figure 71G:
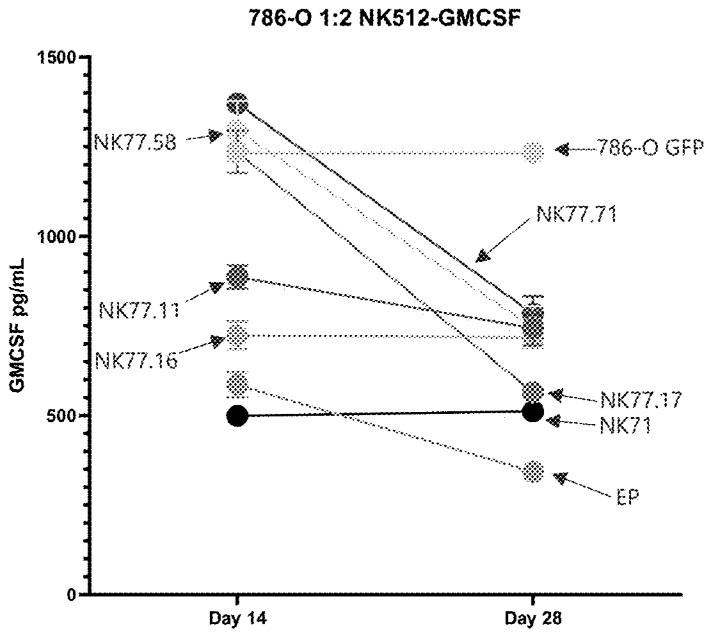
Figure 71H:
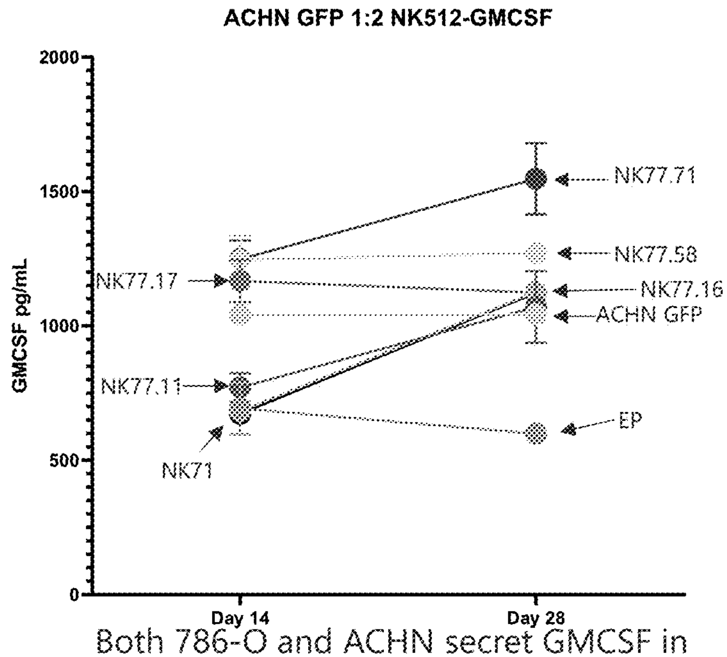
Figure 71I:
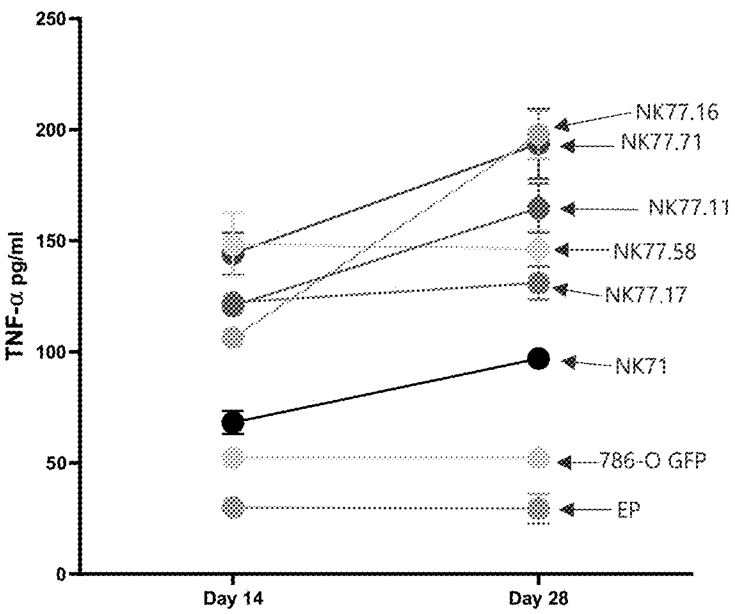
Figure 71J:
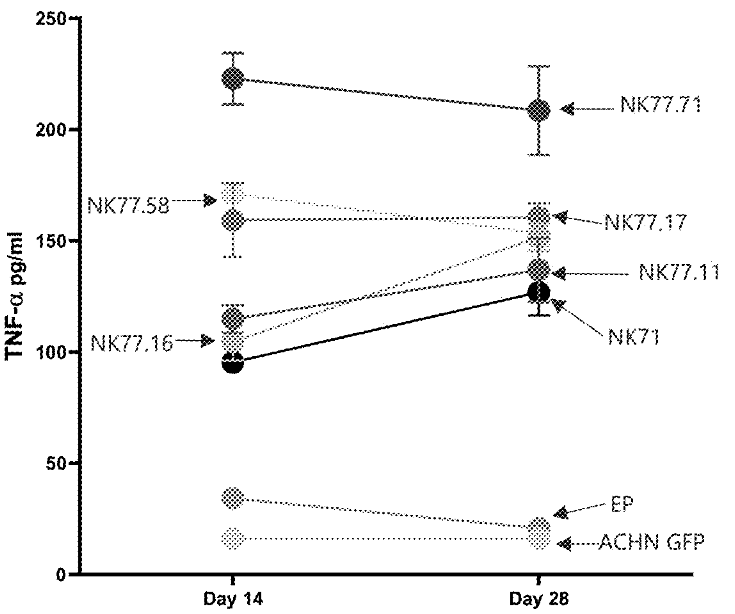
Figure 71L:
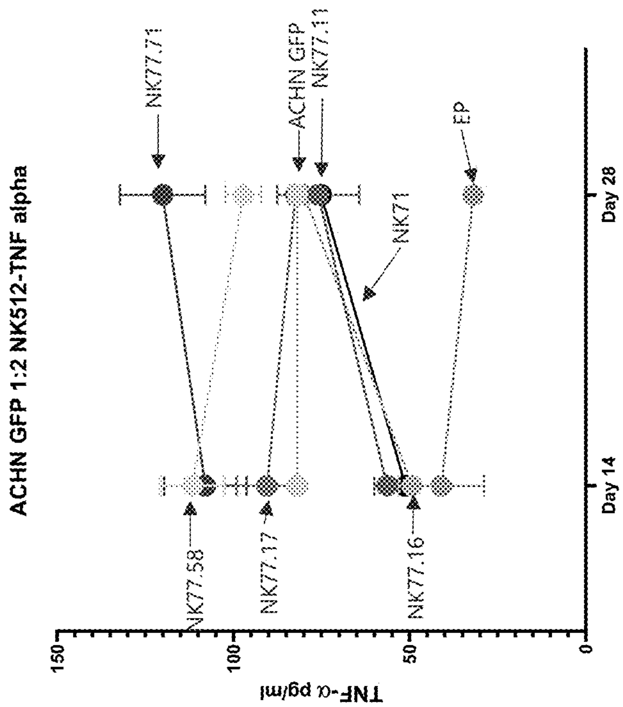
Figure 71K:
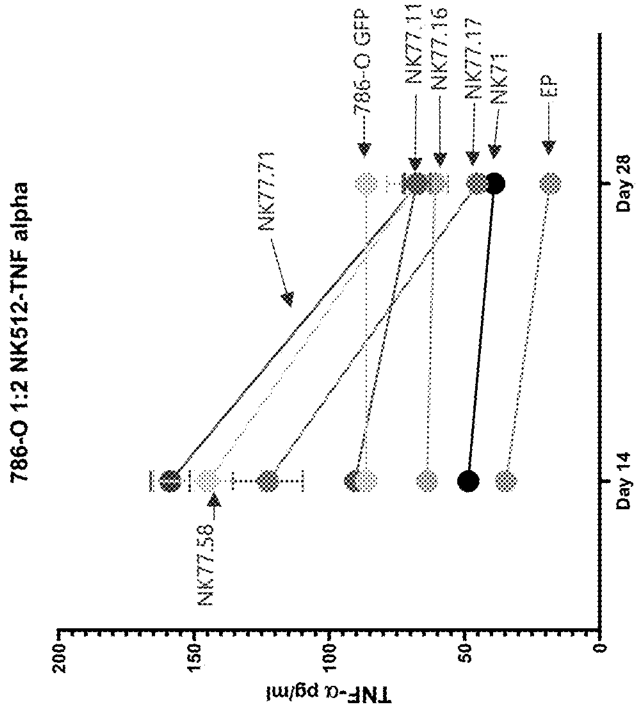
Figure 71M:
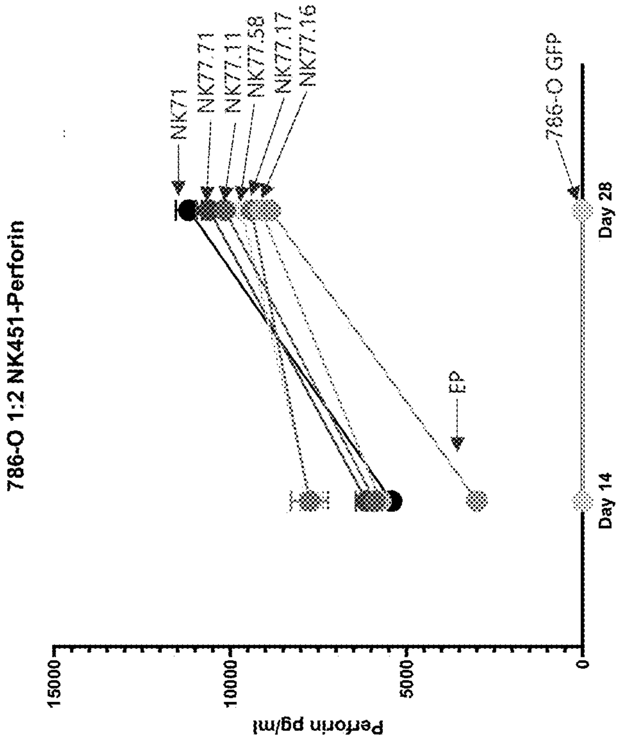
Figure 71N:
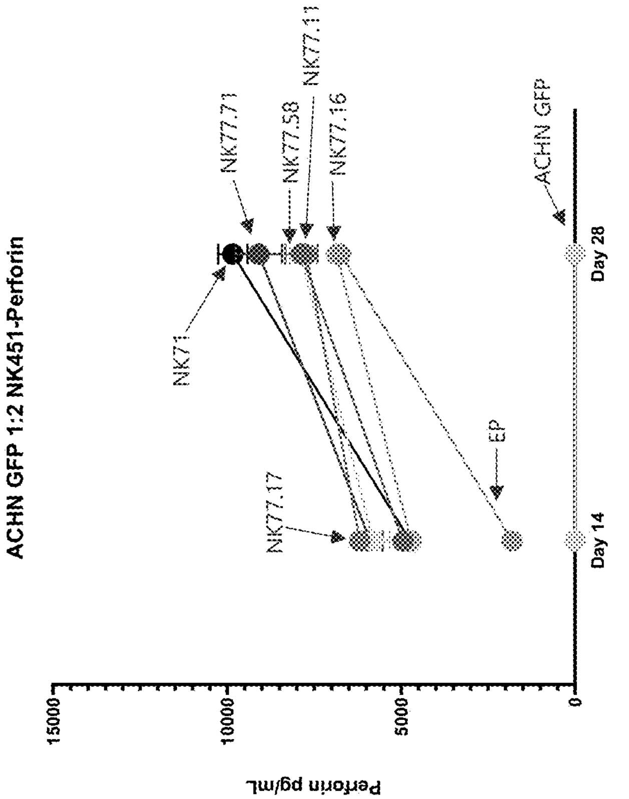
Figure 71O:
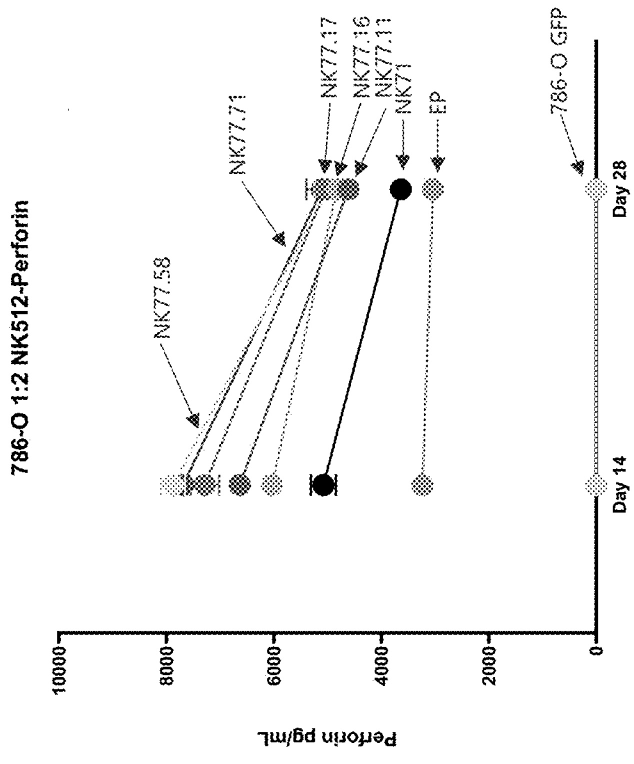
Figure 71P:
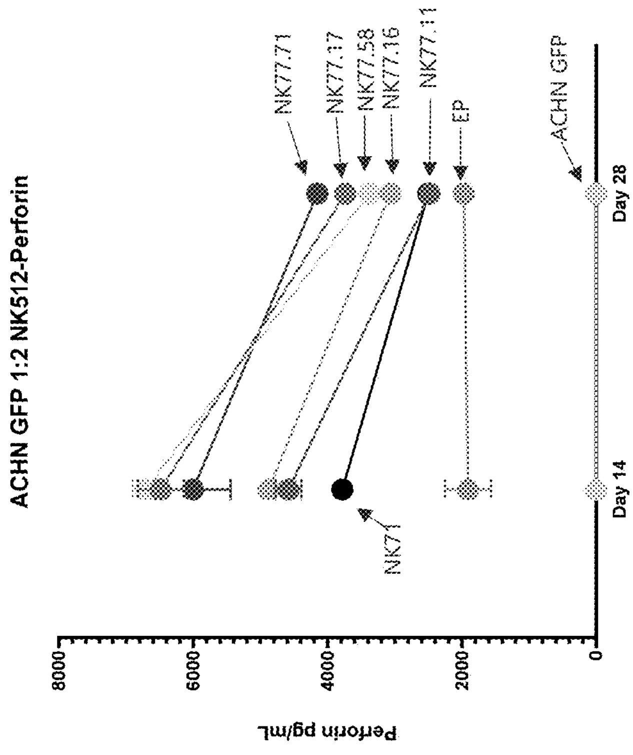
Figure 71Q:
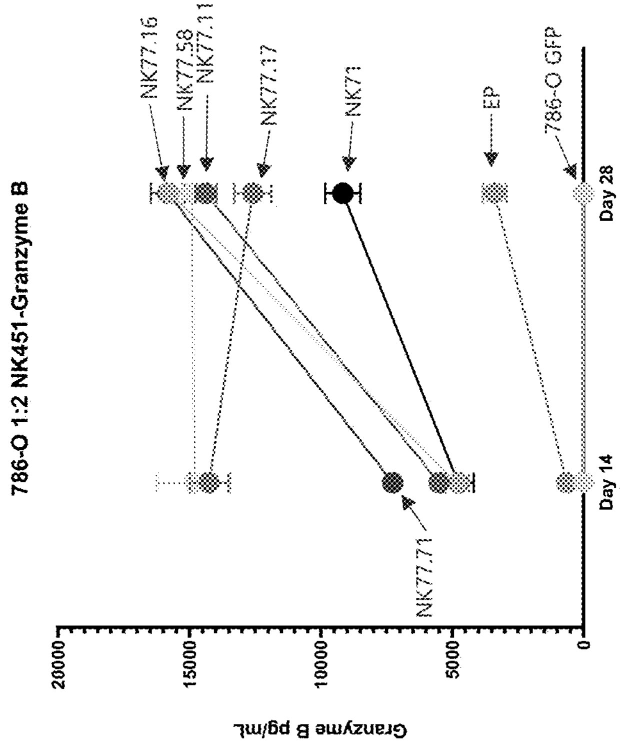
Figure 71R:
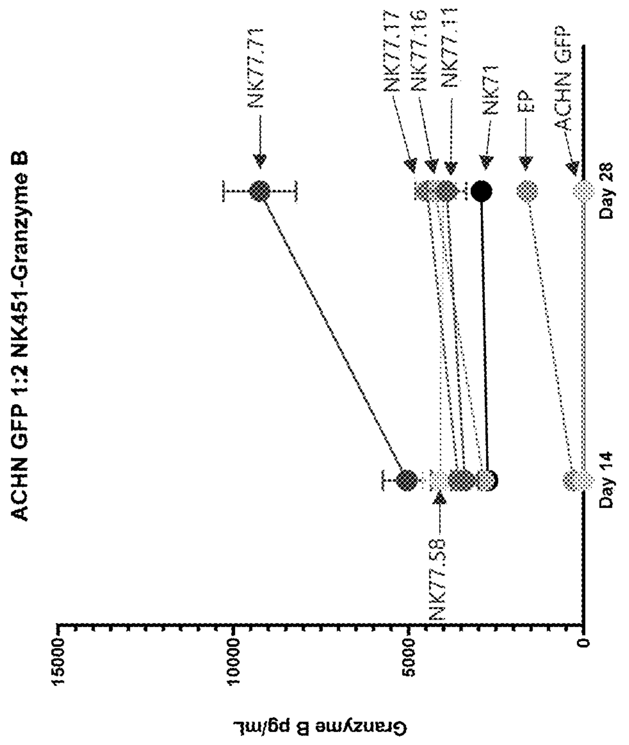
Figure 71T:
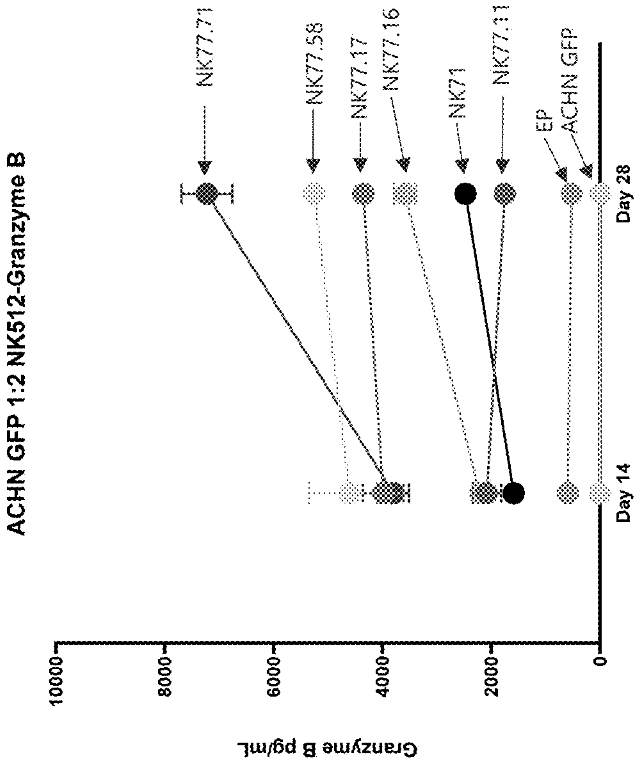
Figure 71S:
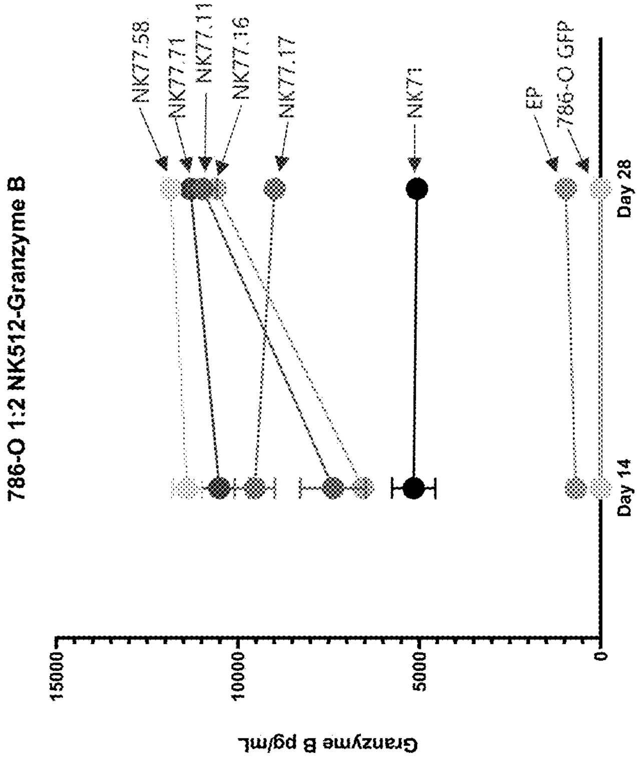

FIGS. 71A-71T show data related to cytokines released by NK cells from one of two donors that are expressing various CD70 CAR constructs (and edited to knockout CD70) when co-cultured with either ACHN or 786-O tumor cells at various effector:target ratios. FIGS. 71A and 71B show levels of interferon-gamma release when cells from the first donor are co-cultured at a 1:2 E:T ratio with 786-O cells (71A) or ACHN cells (71B), with data being collected at day 14 and day 28 after the inception of process for producing the gene edited and transduced cells (e.g., D0 of the non-limiting example process shown in FIG. 49A). FIGS. 71C and 71D show corresponding data from the second donor. FIGS. 71E and 71F shows levels of GMCSF release when cells from the first donor are co-cultured at a 1:2 E:T ratio with 786-O cells (71E) or ACHN cells (71F), with data being collected at day 14 and day 28 after inception of the cell production process. FIGS. 71G and 71H show corresponding data from the second donor. FIGS. 71I and 71J shows levels of TNF-alpha release when cells from the first donor are co-cultured at a 1:2 E:T ratio with 786-O cells (71I) or ACHN cells (71J), with data being collected at day 14 and day 28 after inception of the cell production process. FIGS. 71K and 71L show corresponding data from the second donor. FIGS. 71M and 71N shows levels of perforin release when cells from the first donor are co-cultured at a 1:2 E:T ratio with 786-O cells (71M) or ACHN cells (71N), with data being collected at day 14 and day 28 after inception of the cell production process. FIGS. 71O and 71P show corresponding data from the second donor. FIGS. 71Q and 71R shows levels of Granzyme B release when cells from the first donor are co-cultured at a 1:2 E:T ratio with 786-O cells (71Q) or ACHN cells (71R), with data being collected at day 14 and day 28 after inception of the cell production process. FIGS. 71S and 71T show corresponding data from the second donor.

Figure 72A:
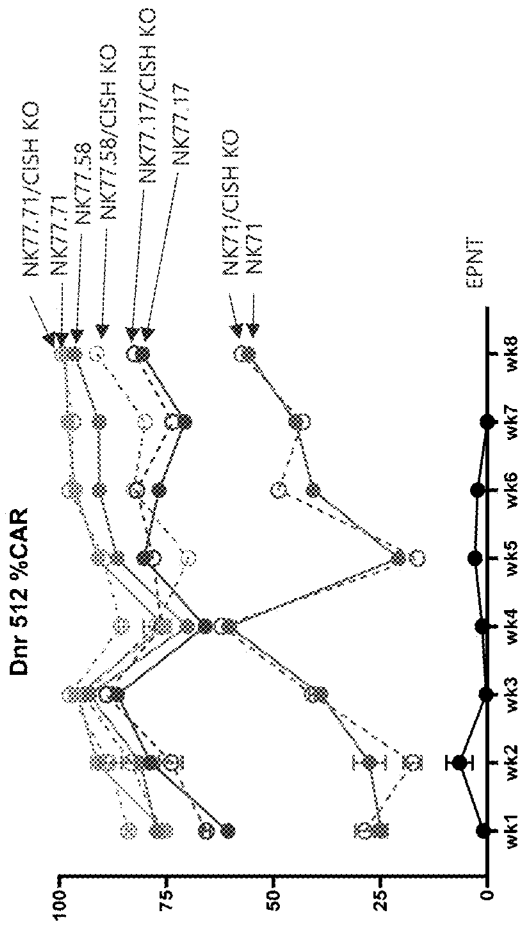
Figure 72B:
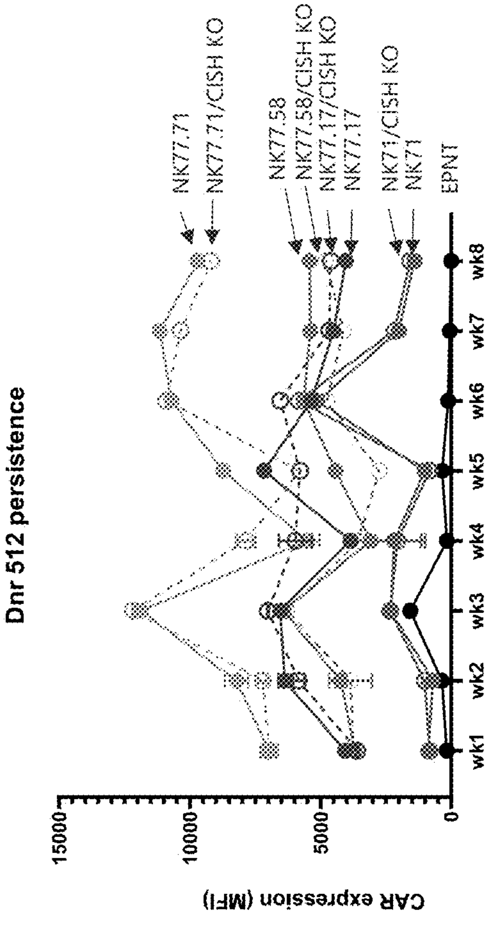
Figure 72C:
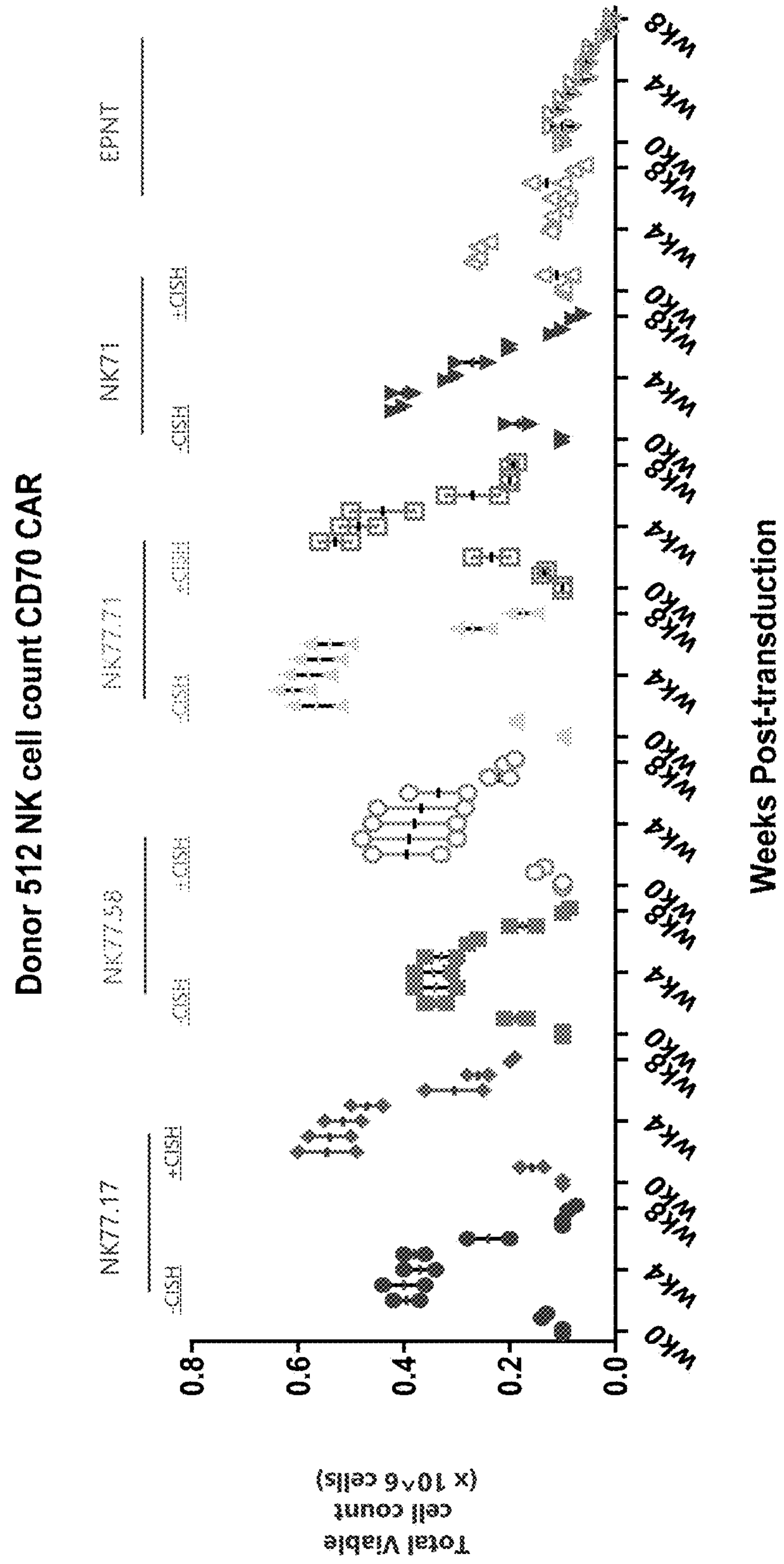
Figure 72D:
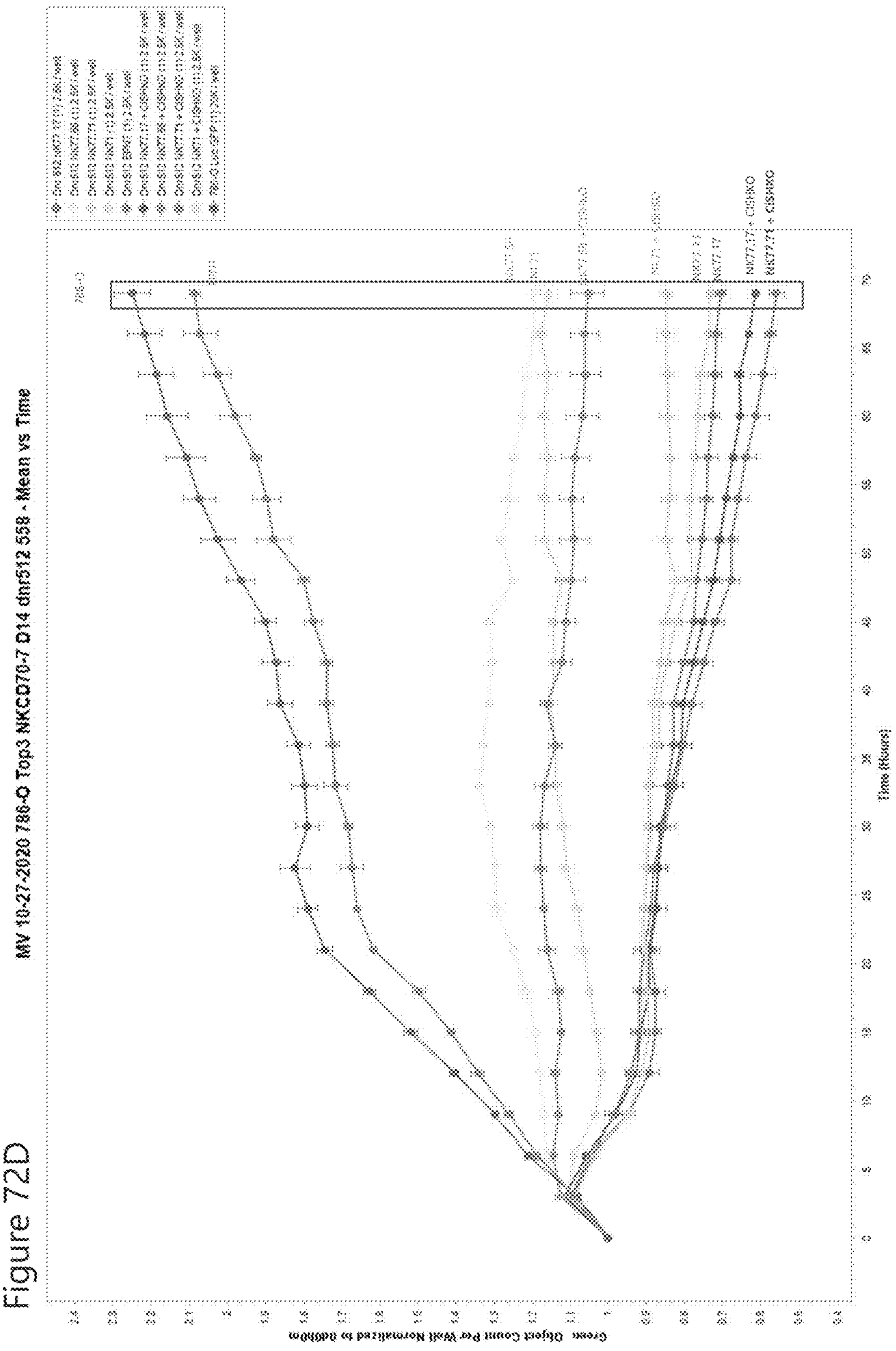
Figure 72E:
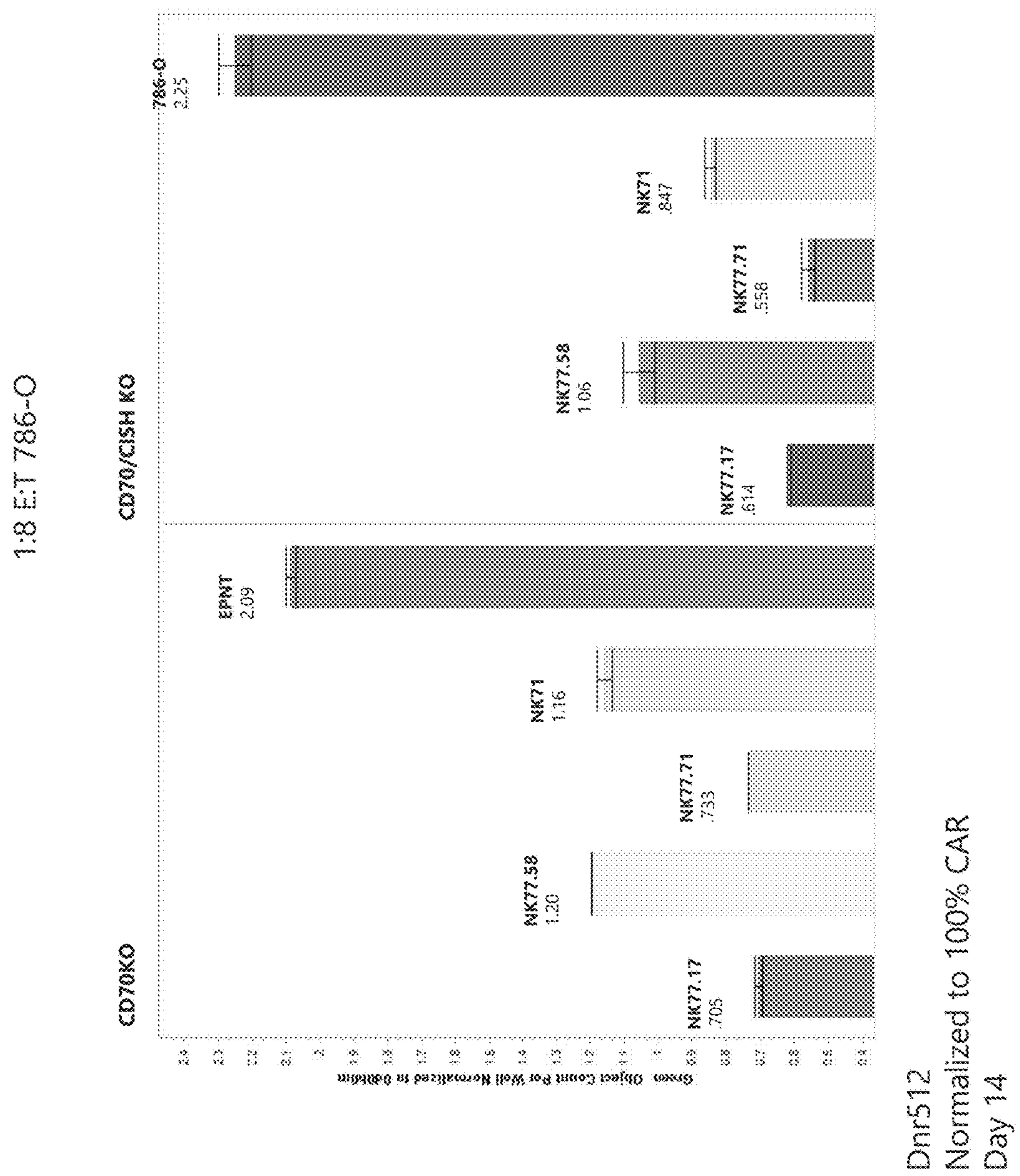
Figure 72F:
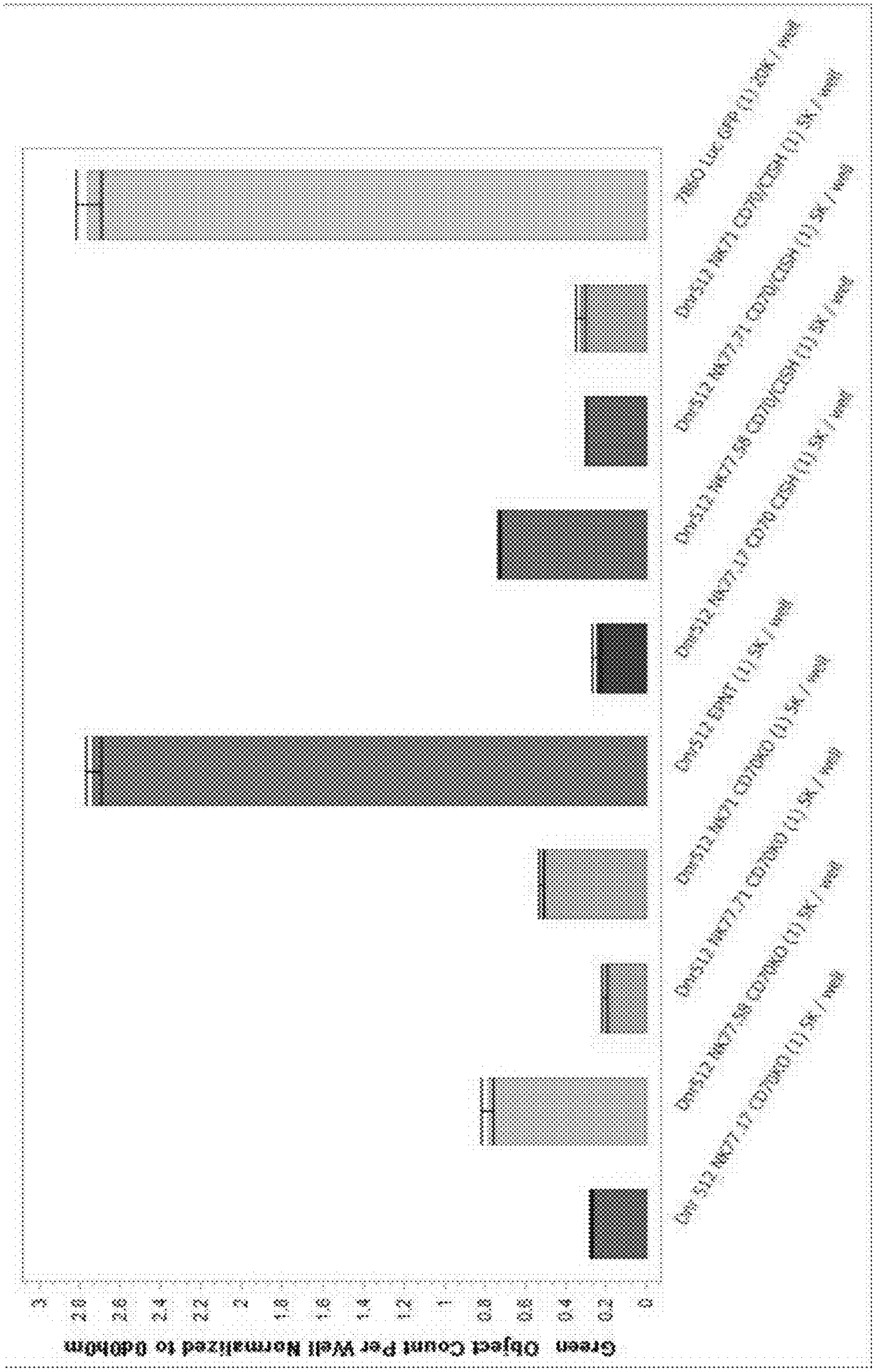
Figure 72G:
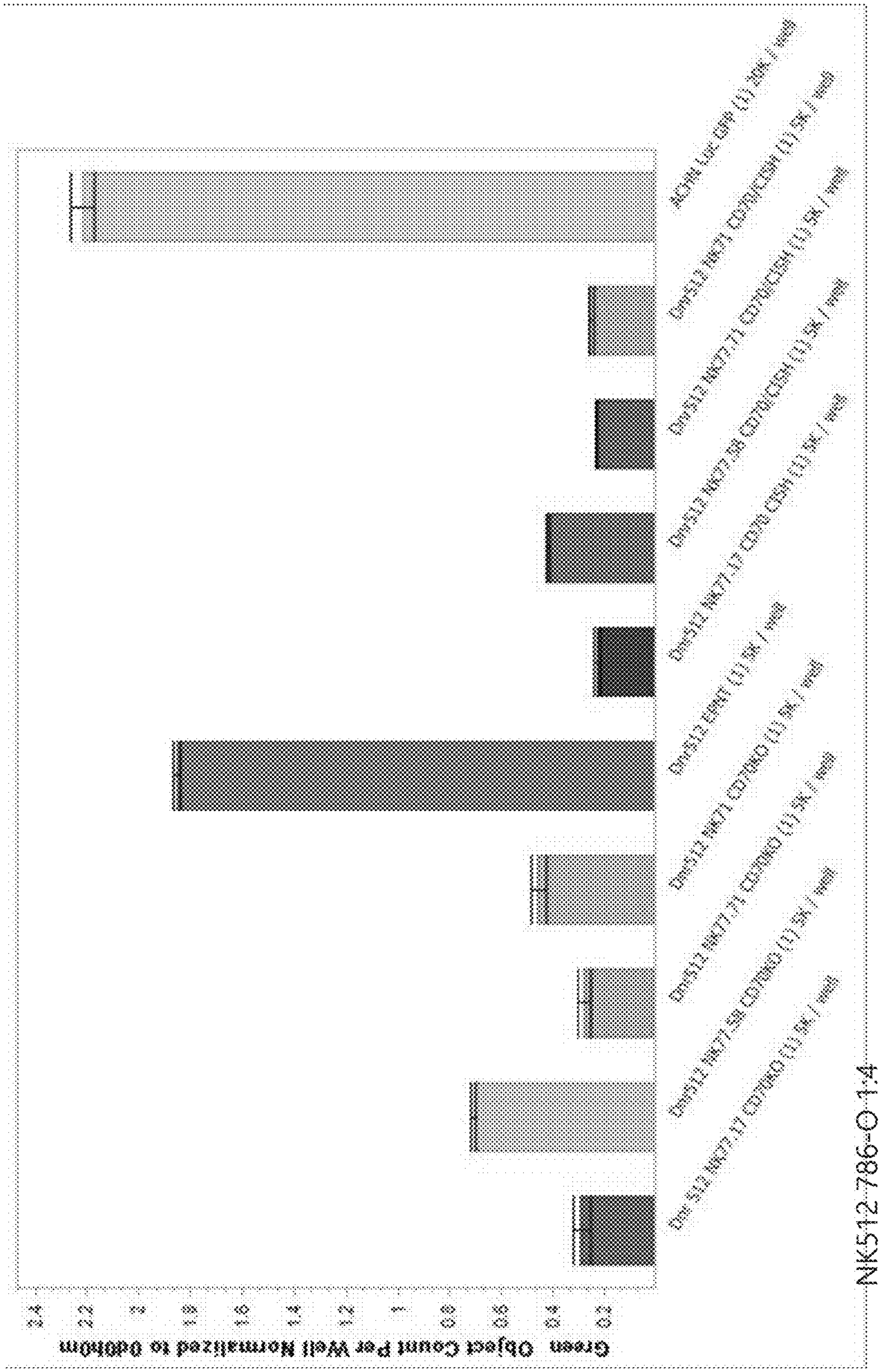

FIGS. 72A-72M show data related to the sustained persistence (both CAR expression and cell viability) and cytotoxicity of NK cells expressing CD70 CARs and edited to knockout one or both of CD70 and CISH. FIG. 72A shows expression data for the indicated CARs over an 8 week period post-transduction, as measured by the percentage of the population expressing the CAR. FIG. 72B shows similar data, as measured by MFI. FIG. 72C shows data related to the survival of the NK cells over the 8 week in vitro period. FIG. 72D shows data related to the cytotoxicity of NK cells expressing the indicated CARs against 786-O cells at 1:8 E:T. FIG. 72E is a histogram that depicts the final green object count per well (indicative of remaining tumor cell population) for each of the constructs from FIG. 72D. FIGS. 72F and 72G are histograms showing the tumor cell count at the final time point of co-culture of donor NK cells expressing the indicated CARs and the indicated edits, at an E:T of 1:4, against ACHN cells (72F) or 786-O cells (72G). FIGS.

Figure 72H:
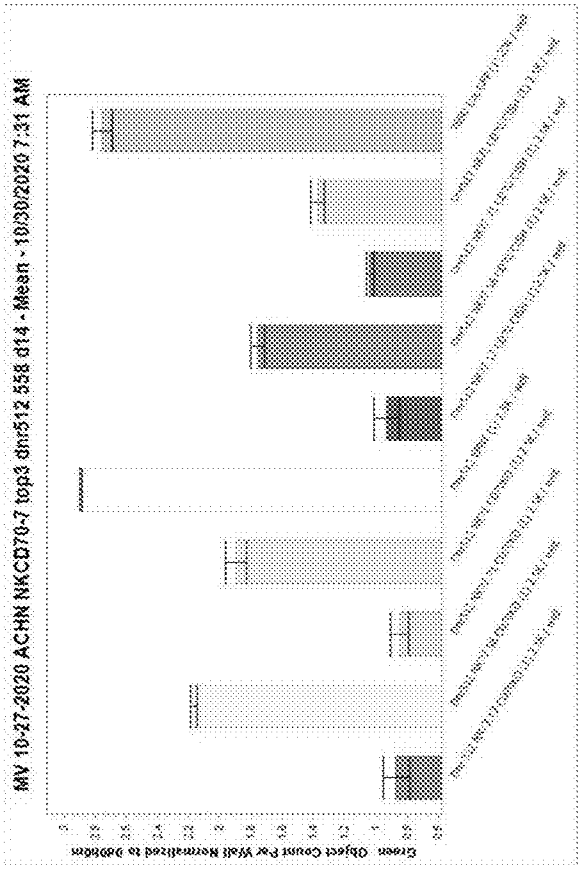
Figure 72I:
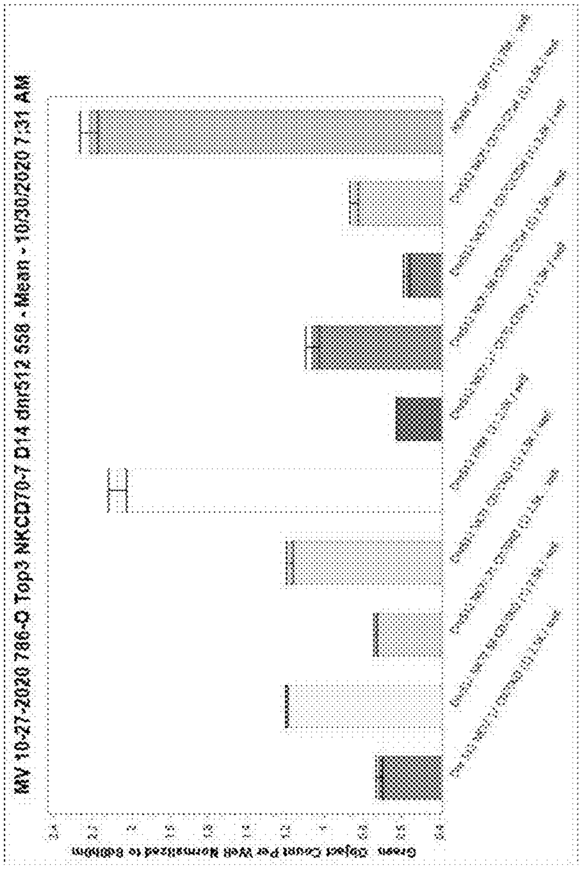
Figure 72J:
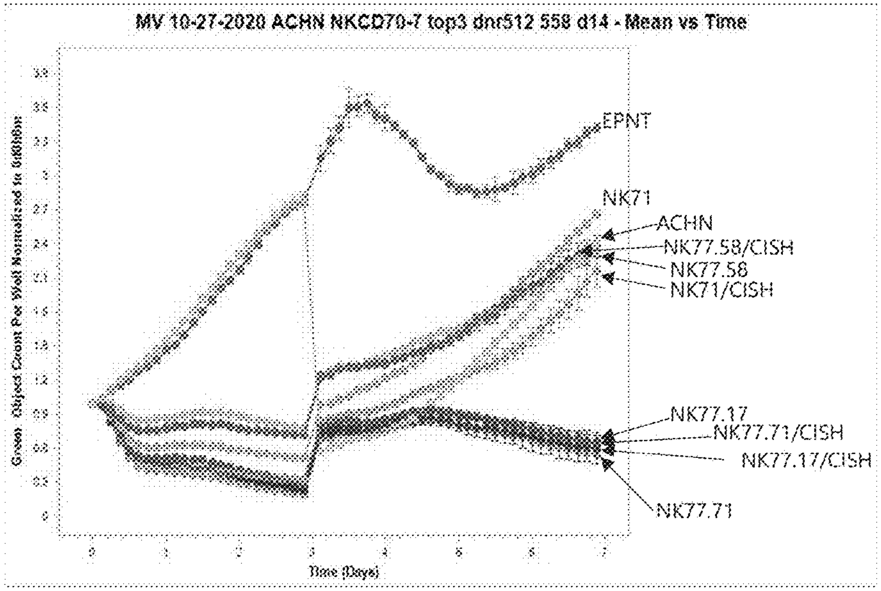
Figure 72K:
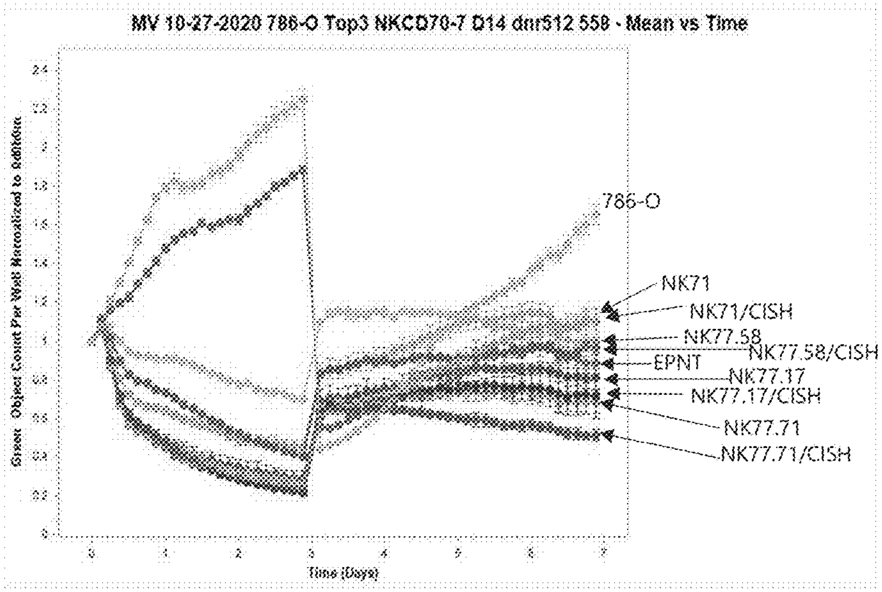
Figure 72L:
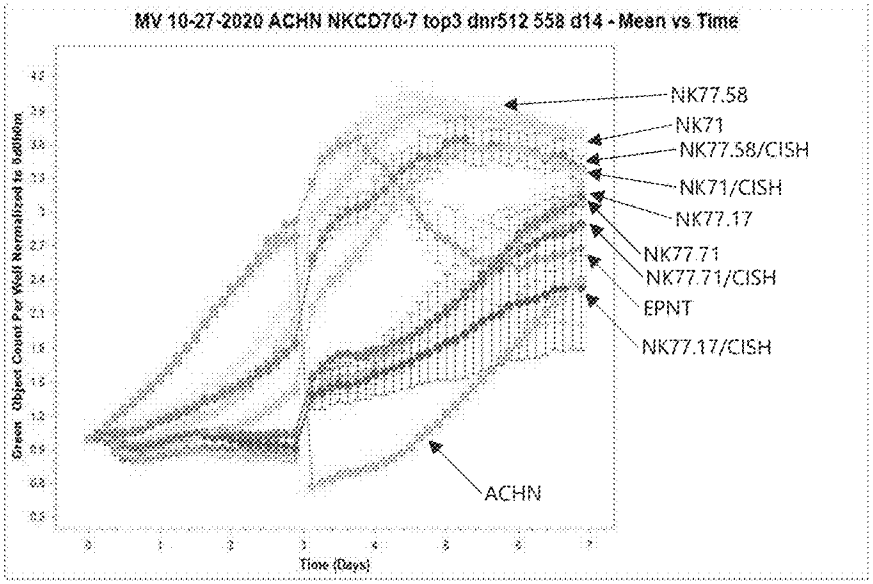
Figure 72M:
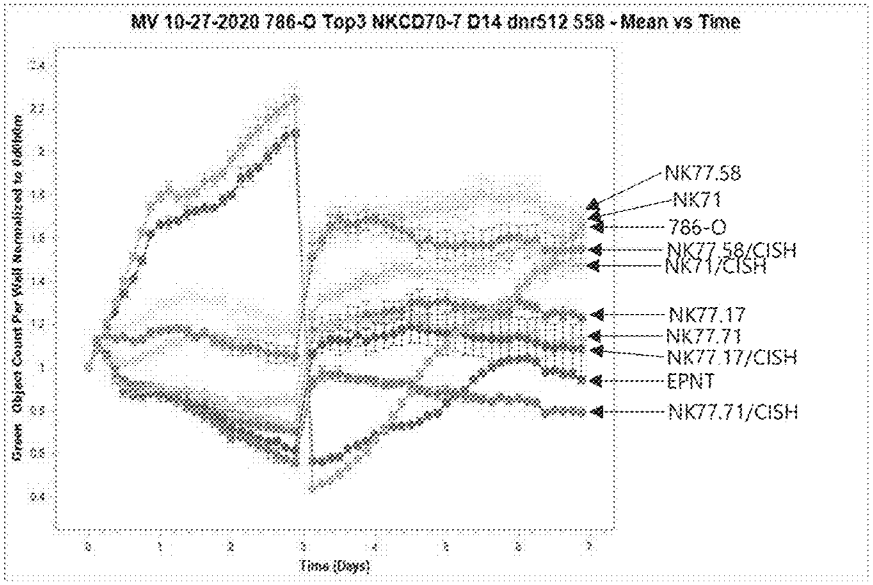

72H and 72I show corresponding data at a 1:8 E:T ratio. FIGS. 72J and 72K show cytotoxicity curves in a re-challenge experimental setup, where the NK cells expressing the indicated CARs, edited for CD70 knockout and edited (or not) for CISH knockout, are re-challenged, at a 1:4 E:T ratio, with ACHN (72J) or 786-O (72K) cells. FIGS. 72L and 72M show corresponding data using a 1:8 E:T ratio.

Figure 73A:
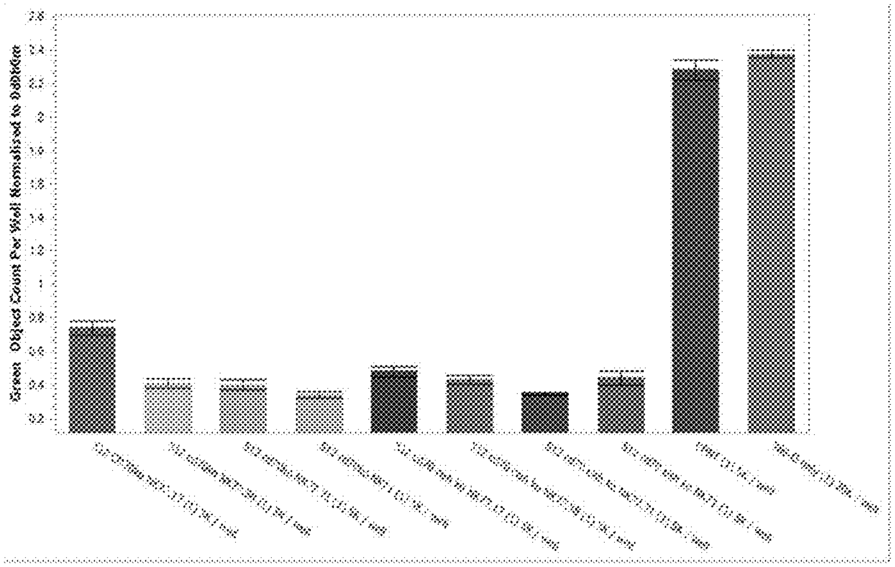
Figure 73B:
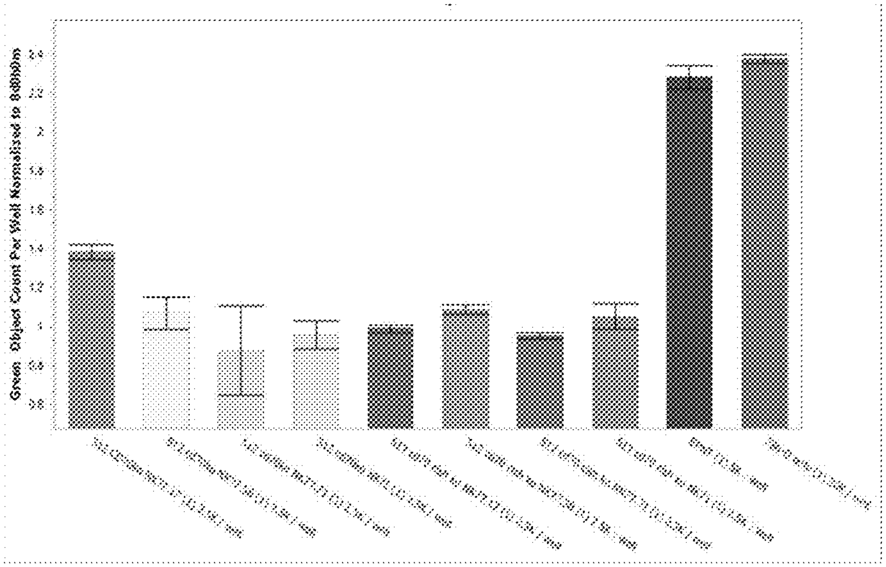
Figure 73C:
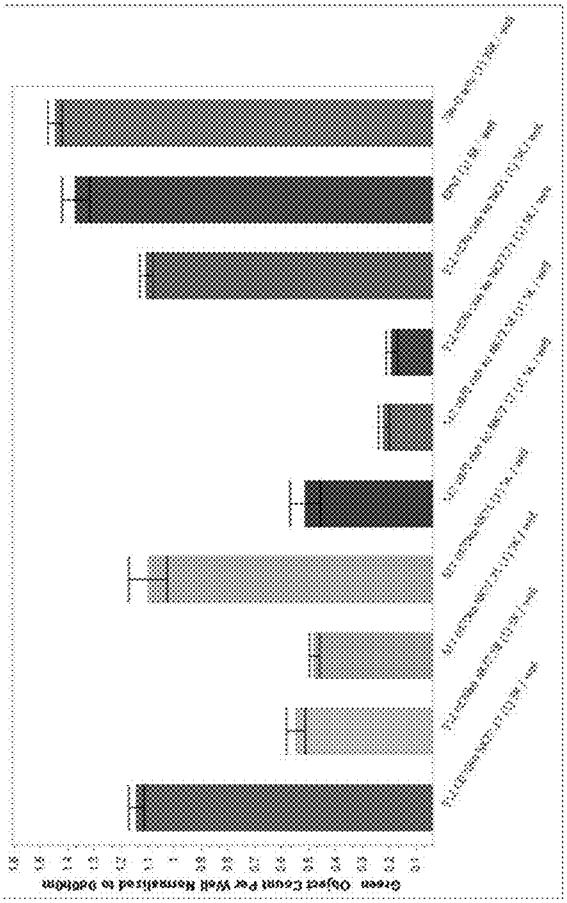
Figure 73D:
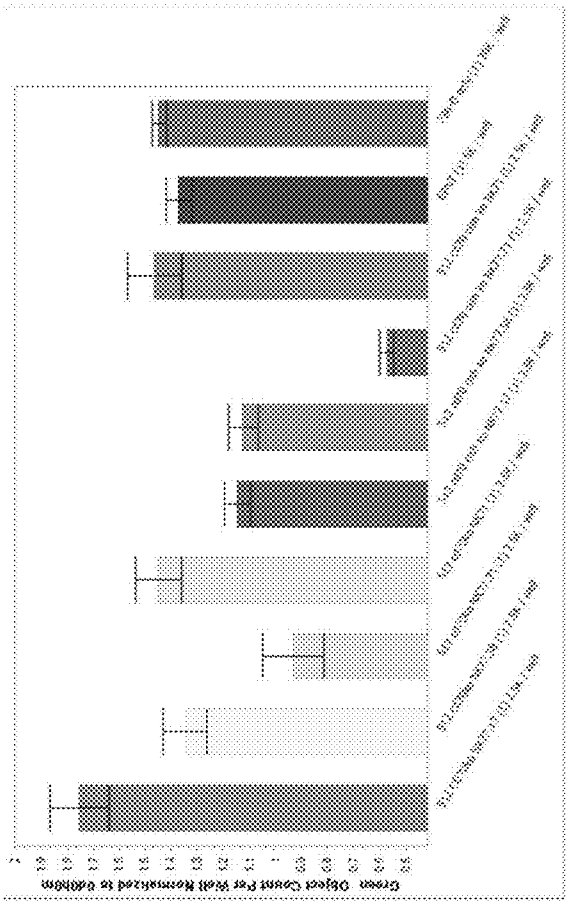
Figure 73E:
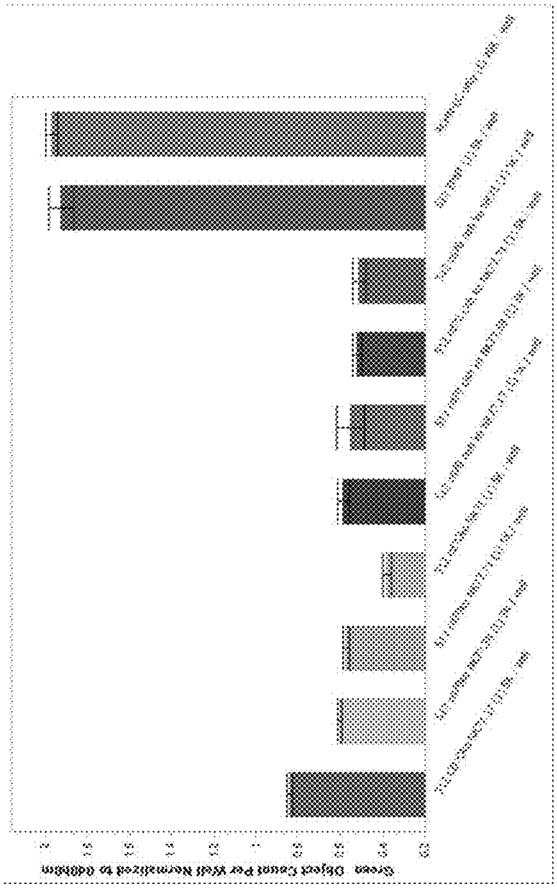
Figure 73F:
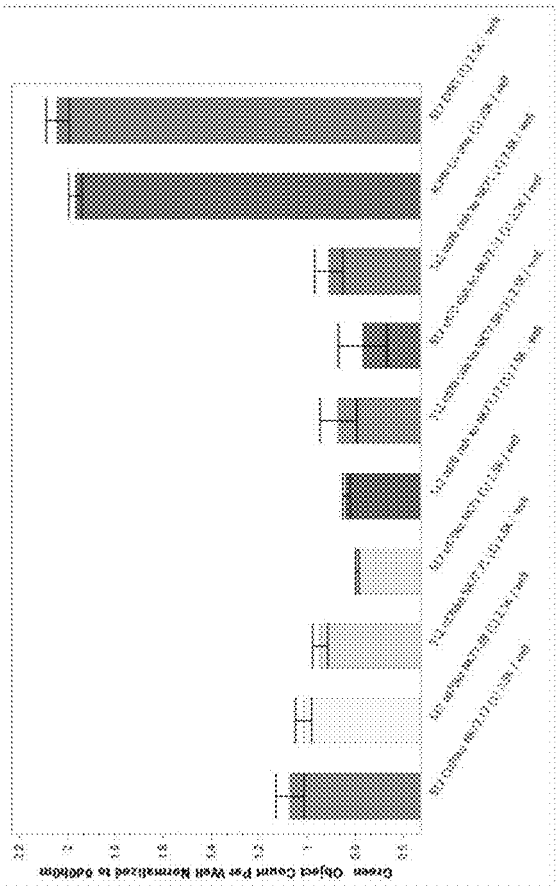
Figure 73G:
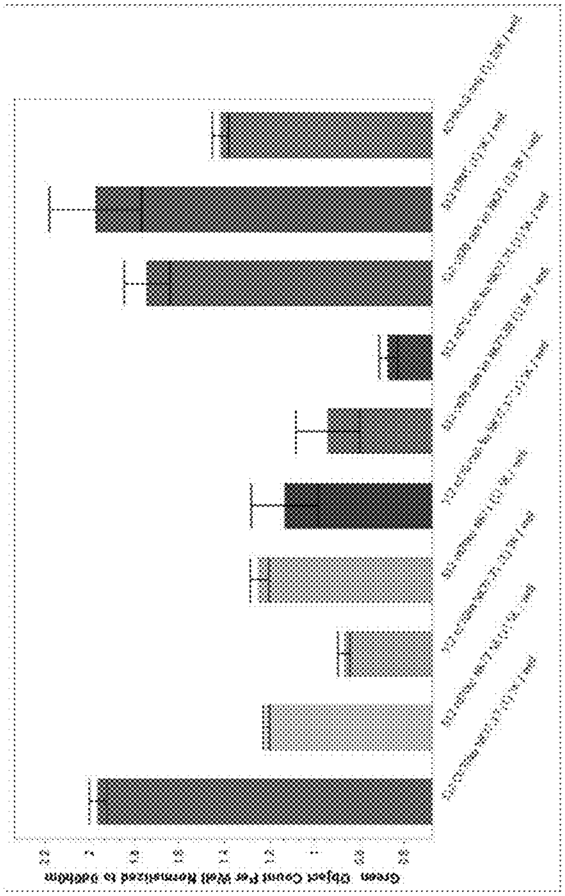

FIGS. 73A-73H show data related to cytotoxicity of selected CAR-expressing NK cells against tumor cells in an in vitro assay prior to and post-rechallenge (assay initiated at 21 days after inception of the cell production process). FIG. 73A shows data regarding 786-O tumor cell presence, using a 1:4 E:T ratio), 72 hours prior to rechallenge. FIG. 73B shows data regarding 786-O tumor cell presence, using a 1:8 E:T ratio), 72 hours prior to rechallenge. FIG. 73C shows data regarding 786-O tumor cell presence, using a 1:4 E:T ratio), 6 days after rechallenge of the NK cells with additional 786-O cells. 73D shows data regarding 786-O tumor cell presence, using a 1:8 E:T ratio), 6 days after rechallenge of the NK cells with additional 786-O cells. FIG. 73E shows data regarding ACHN tumor cell presence, using a 1:4 E:T ratio), 72 hours prior to rechallenge. FIG. 73F shows data regarding ACHN tumor cell presence, using a 1:8 E:T ratio), 72 hours prior to rechallenge. FIG. 73G shows data regarding ACHN tumor cell presence, using a 1:4 E:T ratio), 6 days after rechallenge of the NK cells with additional ACHN cells. 73H shows data regarding ACHN tumor cell presence, using a 1:8 E:T ratio), 6 days after rechallenge of the NK cells with additional ACHN cells.

Figure 74A:
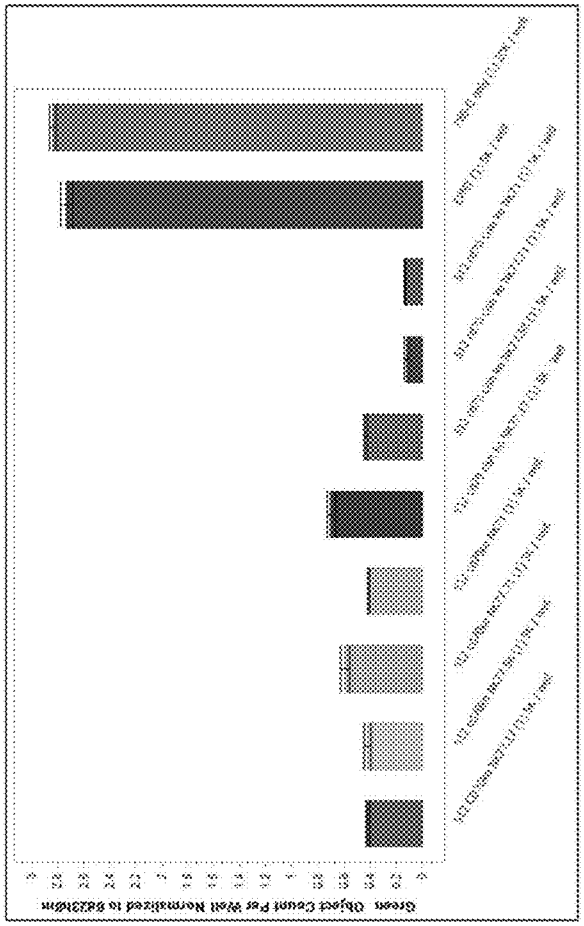
Figure 74B:
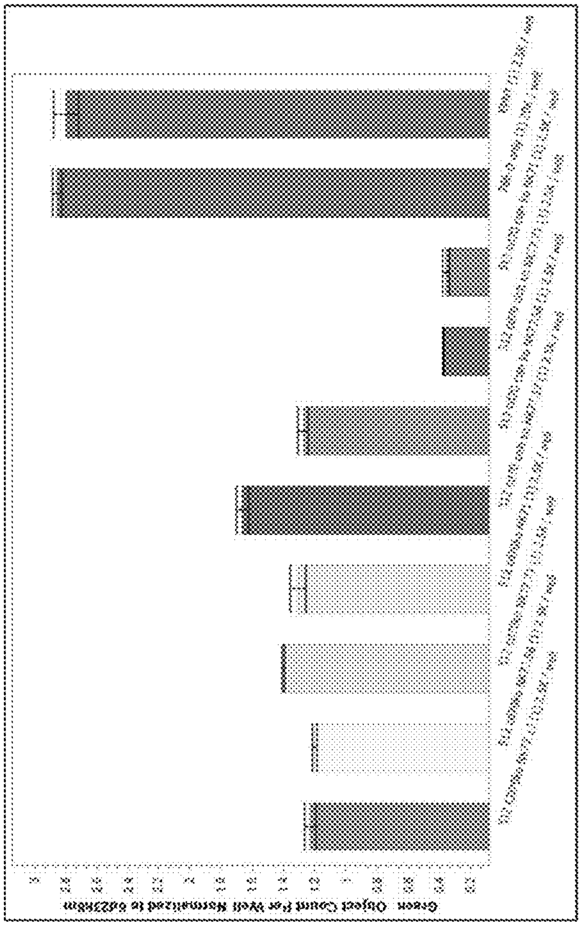
Figure 74C:
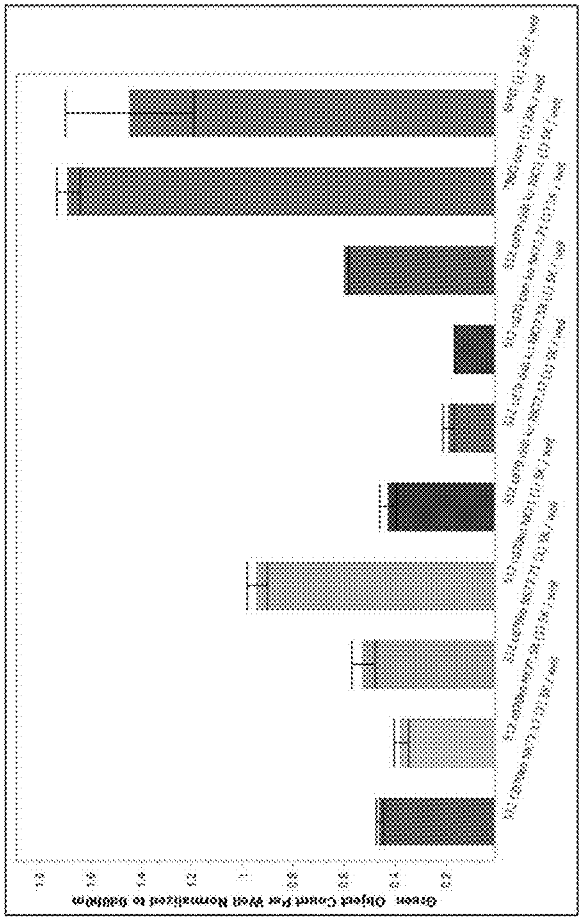
Figure 74D:
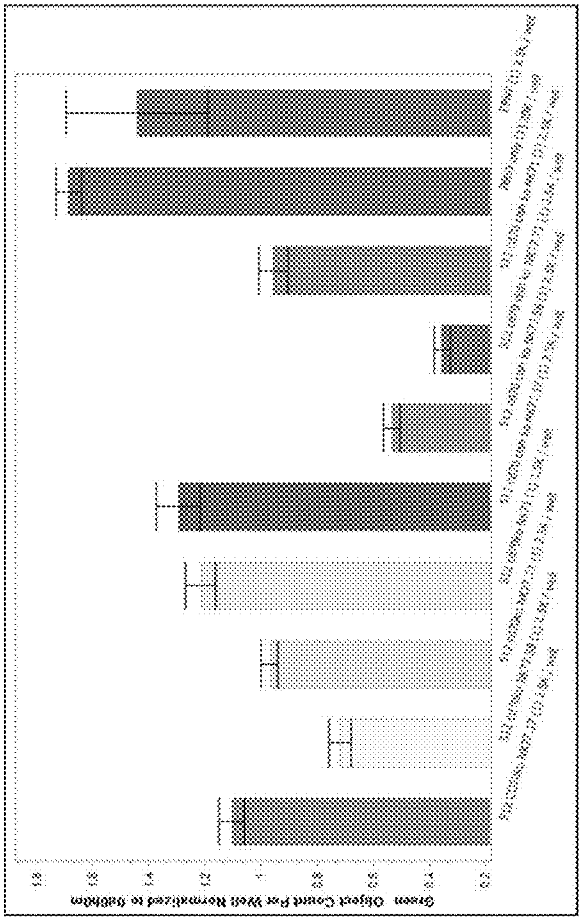
Figure 74E:
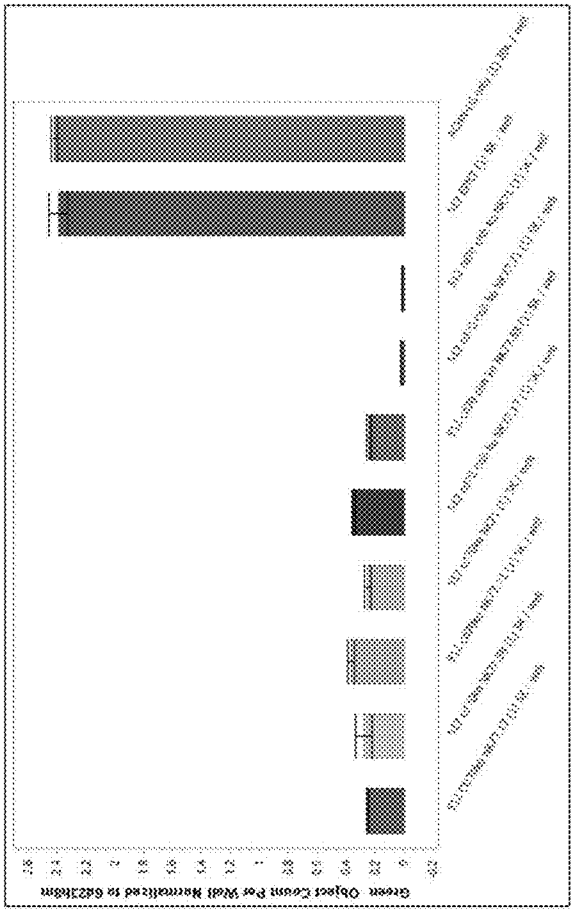
Figure 74F:
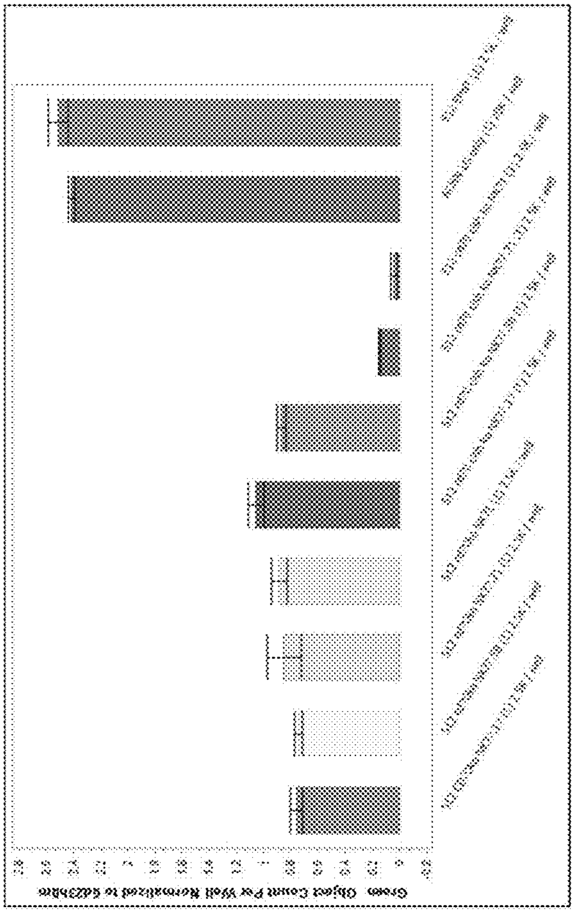
Figure 74G:
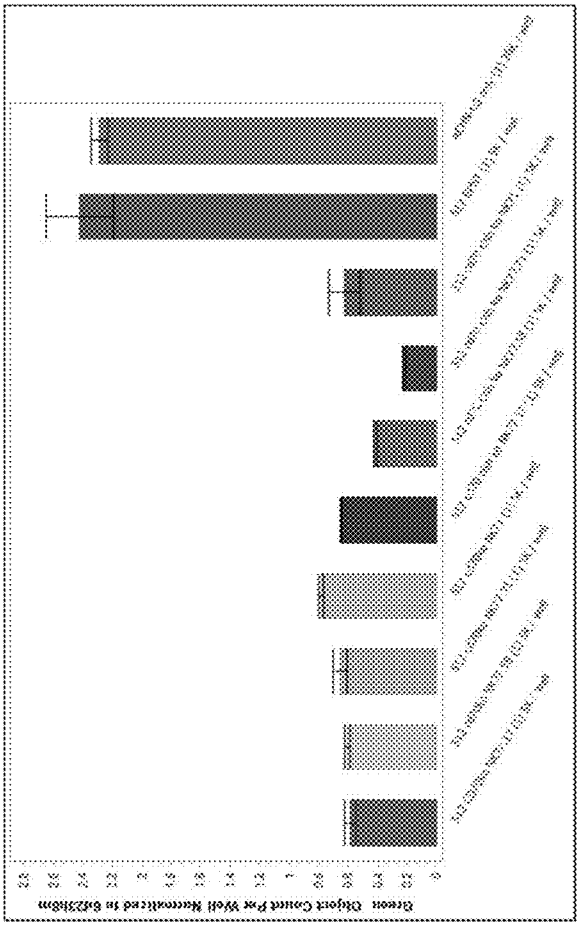
Figure 74H:
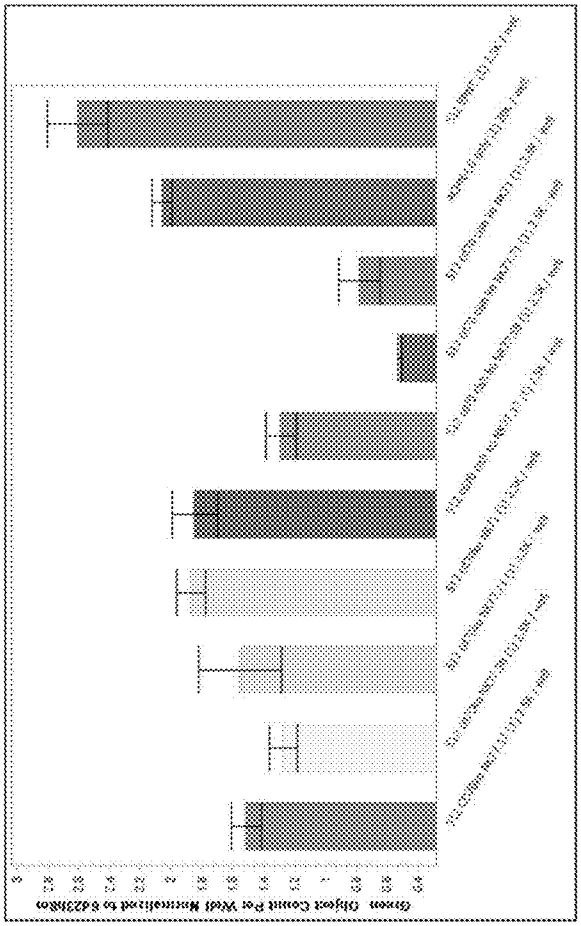

FIGS. 74A-74H show data related to cytotoxicity of selected CAR-expressing NK cells against tumor cells in an in vitro assay prior to and post-rechallenge (assay initiated at 28 days after inception of the cell production process). FIG. 74A shows data regarding 786-O tumor cell presence, using a 1:4 E:T ratio), 72 hours prior to rechallenge. FIG. 74B shows data regarding 786-O tumor cell presence, using a 1:8 E:T ratio), 72 hours prior to rechallenge. FIG. 74C shows data regarding 786-O tumor cell presence, using a 1:4 E:T ratio), 6 days after rechallenge of the NK cells with additional 786-O cells. 74D shows data regarding 786-O tumor cell presence, using a 1:8 E:T ratio), 6 days after rechallenge of the NK cells with additional 786-O cells. FIG. 74E shows data regarding ACHN tumor cell presence, using a 1:4 E:T ratio), 72 hours prior to rechallenge. FIG. 74F shows data regarding ACHN tumor cell presence, using a 1:8 E:T ratio), 72 hours prior to rechallenge. FIG. 74G shows data regarding ACHN tumor cell presence, using a 1:4 E:T ratio), 6 days after rechallenge of the NK cells with additional ACHN cells. 74H shows data regarding ACHN tumor cell presence, using a 1:8 E:T ratio), 6 days after rechallenge of the NK cells with additional ACHN cells.

Figure 75A:
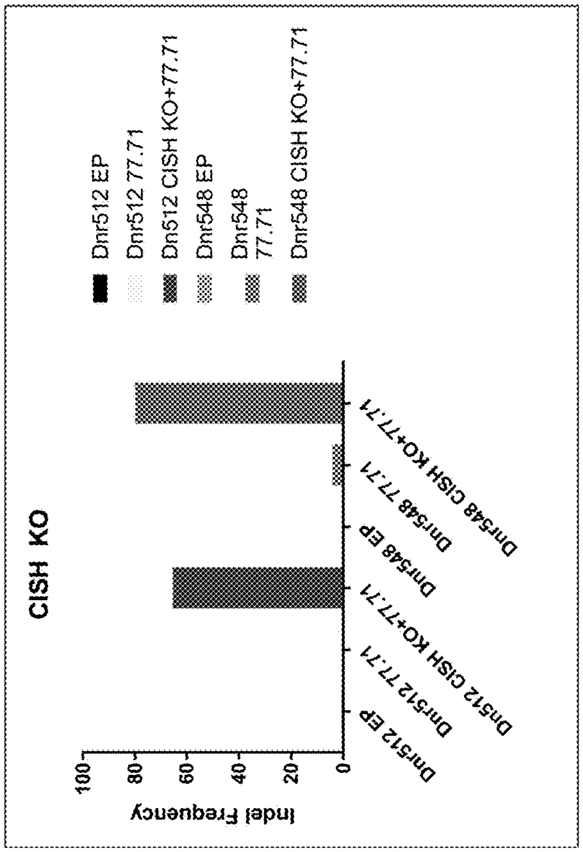
Figure 75B:
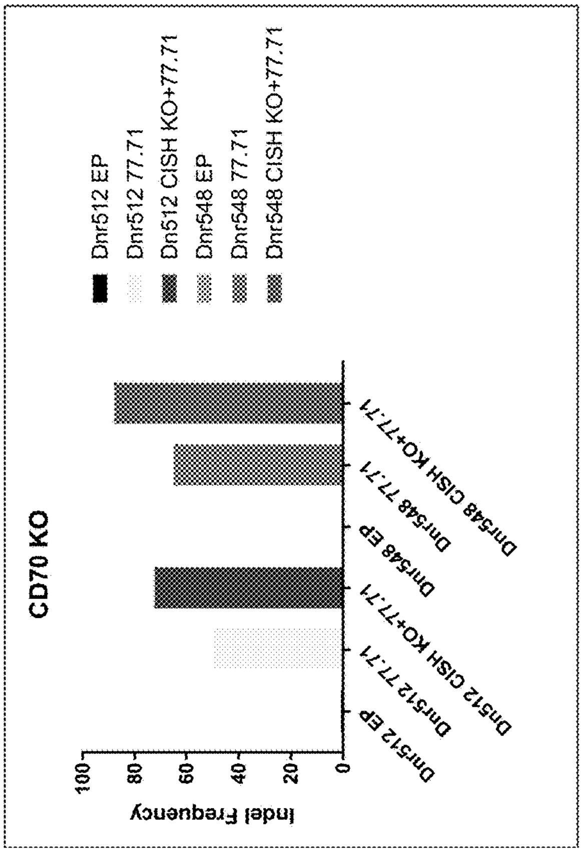
Figure 75C:
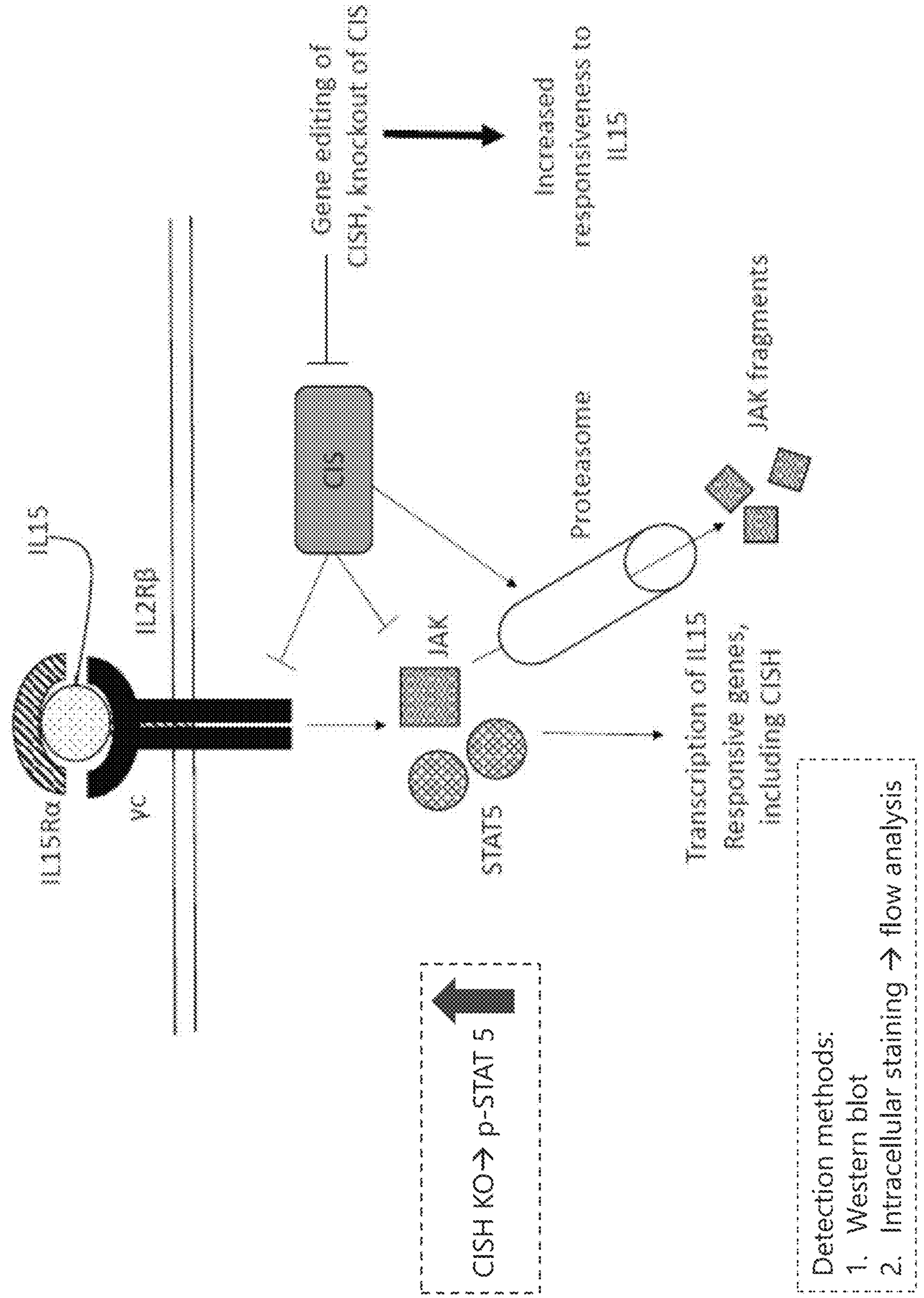
Figure 75D:
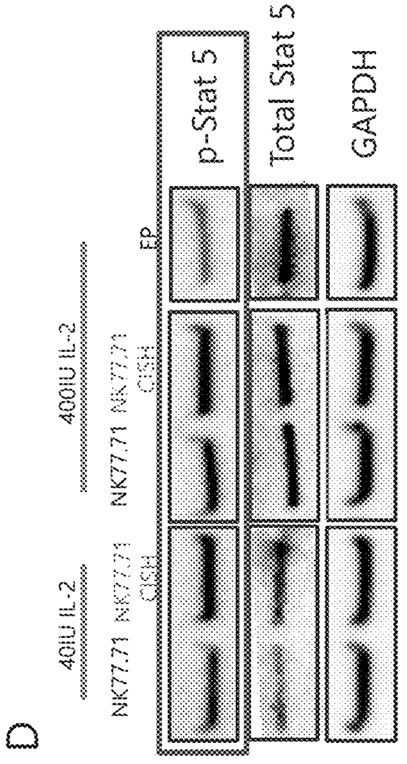
Figure 75E:
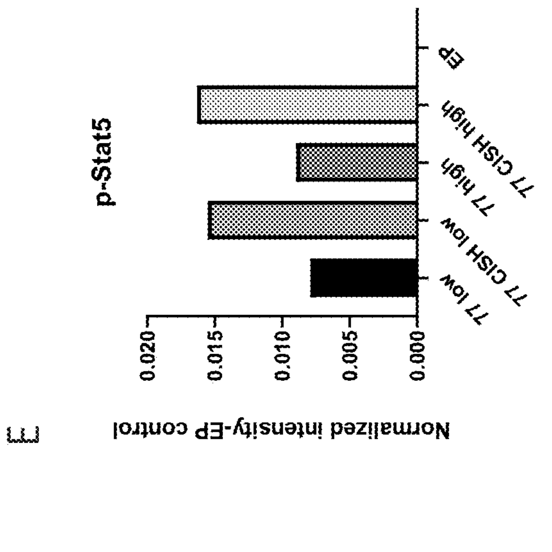
Figure 75F:
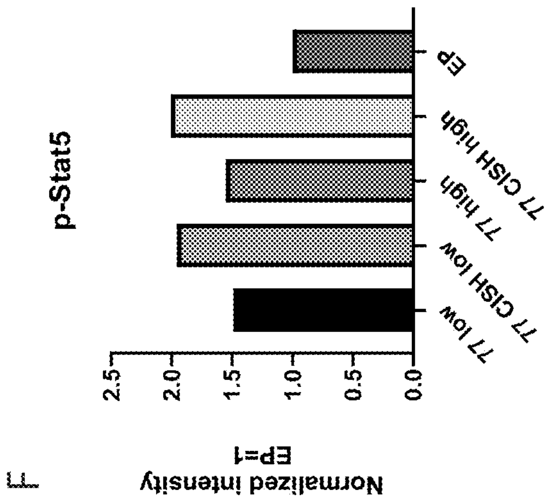

FIGS. 75A-75F show data related to Indel frequency and assessment of CISH KO. FIG. 75A shows detection of Indel frequency with respect to edits in CISH. FIG. 75B shows detection of Indel frequency with respect to edits in CD70. FIG. 75C shows a schematic of a CISH signaling pathway. FIG. 75D shows western blot data assessing expressing of phosphorylated Stat 5, a signaling molecule downstream of CIS. FIG. 75E shows quantification data normalized to the electroporation control. FIG. 75F shows data normalized to the electroporation control at a value of 1.

DETAILED DESCRIPTION

Some embodiments of the methods and compositions provided herein relate to engineered immune cells and combinations of the same for use in immunotherapy. In several embodiments, the engineered cells are engineered in multiple ways, for example, to express a cytotoxicity-inducing receptor complex. As used herein, the term "cytotoxic receptor complexes" shall be given its ordinary meaning and shall also refer to (unless otherwise indicated), Chimeric Antigen Receptors (CAR), chimeric receptors (also called activating chimeric receptors in the case of NKG2D chimeric receptors). In several embodiments, the cells are further engineered to achieve a modification of the reactivity of the cells against non-tumor tissue and/or other therapeutic cells. In several embodiments, natural killer (NK) cells are also engineered to express a cytotoxicity-inducing receptor complex (e.g., a chimeric antigen receptor or chimeric receptor), such as for example targeting CD70 expressing tumor cells. In several embodiments, the NK cells are genetically edited to reduce and/or eliminate certain markers/proteins that would otherwise inhibit or limit the therapeutic efficacy of the CAR-expressing NK cells. In several embodiments, certain markers/proteins have expression that is upregulated or otherwise induced by one or more processes undertaken to engineer and/or expand the NK cells. For example, in several embodiments, the process of expanding NK cells in culture results in substantially increased CD70 expression by the NK cells. In those embodiments wherein a CD70 CAR is engineered to be expressed by expanded NK cells, the CAR would actually target, not only a CD70-expressing tumor, but other engineered and expanded NK cells as well (based on the increased expression of CD70 resulting from culture of the cells). Thus, for example, in several embodiments, therapeutic NK cells are engineered to express a CAR that targets CD70 and are likewise genetically edited to knock out CD70 expression on the NK cells themselves, which, if present, would cause the CAR-expressing NK cells to target the tumor and the therapeutic NK cells as well. This would otherwise create a self-limiting therapeutic effect, which could allow for tumor expansion and progression of the cancer.

The term "anticancer effect" refers to a biological effect which can be manifested by various means, including but not limited to, a decrease in tumor volume, a decrease in the number of cancer cells, a decrease in the number of metastases, an increase in life expectancy, decrease in cancer cell proliferation, decrease in cancer cell survival, and/or amelioration of various physiological symptoms associated with the cancerous condition.

Cell Types

Some embodiments of the methods and compositions provided herein relate to a cell such as an immune cell. For example, an immune cell, such as an NK cell or a T cell, may be engineered to include a chimeric receptor such as a CD70-directed chimeric receptor, or engineered to include a nucleic acid encoding said chimeric receptor as described herein. Additional embodiments relate to engineering a second set of cells to express another cytotoxic receptor complex, such as an NKG2D chimeric receptor complex as disclosed herein. Still additional embodiments relate to the further genetic manipulation of the cells (e.g., donor NK cells) to reduce, disrupt, minimize and/or eliminate the expression of one or more markers/proteins by the NK cells, resulting in an enhancement of the efficacy and/or persistence of the engineered NK cells.

Traditional anti-cancer therapies relied on a surgical approach, radiation therapy, chemotherapy, or combinations of these methods. As research led to a greater understanding of some of the mechanisms of certain cancers, this knowledge was leveraged to develop targeted cancer therapies. Targeted therapy is a cancer treatment that employs certain drugs that target specific genes or proteins found in cancer cells or cells supporting cancer growth, (like blood vessel cells) to reduce or arrest cancer cell growth. More recently, genetic engineering has enabled approaches to be developed that harness certain aspects of the immune system to fight cancers. In some cases, a patient's own immune cells are modified to specifically eradicate that patient's type of cancer. Various types of immune cells can be used, such as T cells, Natural Killer (NK cells), or combinations thereof, as described in more detail below.

To facilitate cancer immunotherapies, there are provided for herein polynucleotides, polypeptides, and vectors that encode chimeric antigen receptors (CAR) that comprise a target binding moiety (e.g., an extracellular binder of a ligand, or a tumor marker-directed chimeric receptor, expressed by a cancer cell) and a cytotoxic signaling complex. For example, some embodiments include a polynucleotide, polypeptide, or vector that encodes, for example a chimeric antigen receptor directed against a tumor marker, for example, CD70, CD19, CD123, Her2, mesothelin, Claudin 6, BCMA, EGFR, among others, to facilitate targeting of an immune cell to a cancer and exerting cytotoxic effects on the cancer cell. Also provided are engineered immune cells (e.g., NK cells and/or T cells) expressing such CARs. There are also provided herein, in several embodiments, polynucleotides, polypeptides, and vectors that encode a construct comprising an extracellular domain comprising two or more subdomains, e.g., a first CD70-targeting subdomain comprising an anti-CD70 binding domain as disclosed herein and a second subdomain comprising an additional binding moiety, for example a C-type lectin-like receptor and a cytotoxic signaling complex, or alternatively another anti-CD70 binding domain. Also provided are engineered immune cells (e.g., NK cells and/or T cells) expressing such bi-specific constructs. Methods of treating cancer and other uses of such cells for cancer immunotherapy are also provided for herein.

To facilitate cancer immunotherapies, there are also provided for herein polynucleotides, polypeptides, and vectors that encode chimeric receptors that comprise a target binding moiety (e.g., an extracellular binder of a ligand expressed by a cancer cell) and a cytotoxic signaling complex. For example, some embodiments include a polynucleotide, polypeptide, or vector that encodes, for example an activating chimeric receptor comprising an NKG2D extracellular domain that is directed against a tumor marker, for example, MICA, MICB, ULBP1, ULBP2, ULBP3, ULBP4, ULBP5, and ULBP6, among others, to facilitate targeting of an immune cell to a cancer and exerting cytotoxic effects on the cancer cell. Also provided are engineered immune cells (e.g., NK cells and/or T cells) expressing such chimeric receptors. There are also provided herein, in several embodiments, polynucleotides, polypeptides, and vectors that encode a construct comprising an extracellular domain comprising two or more subdomains, e.g., first and second ligand binding receptor and a cytotoxic signaling complex. Also provided are engineered immune cells (e.g., NK cells and/or T cells) expressing such bi-specific constructs (in some embodiments the first and second ligand binding domain target the same ligand). Methods of treating cancer and other uses of such cells for cancer immunotherapy are also provided for herein.

Engineered Cells for Immunotherapy

In several embodiments, cells of the immune system are engineered to have enhanced cytotoxic effects against target cells, such as tumor cells. For example, a cell of the immune system may be engineered to include a tumor-directed chimeric receptor and/or a tumor-directed CAR as described herein. In several embodiments, white blood cells or leukocytes, are used, since their native function is to defend the body against growth of abnormal cells and infectious disease. There are a variety of types of white bloods cells that serve specific roles in the human immune system, and are therefore a preferred starting point for the engineering of cells disclosed herein. White blood cells include granulocytes and agranulocytes (presence or absence of granules in the cytoplasm, respectively). Granulocytes include basophils, eosinophils, neutrophils, and mast cells. Agranulocytes include lymphocytes and monocytes. Cells such as those that follow or are otherwise described herein may be engineered to include a chimeric antigen receptor, such as a CD70-directed CAR, or a nucleic acid encoding the CAR. In several embodiments, the cells are optionally engineered to co-express a membrane-bound interleukin 15 (mbIL15) domain. As discussed in more detail below, in several embodiments, the therapeutic cells, are further genetically modified enhance the cytotoxicity and/or persistence of the cells. In several embodiments, the genetic modification enhances the ability of the cell to resist signals emanating from the tumor microenvironment that would otherwise cause a reduced efficacy or shortened lifespan of the therapeutic cells.

Monocytes for Immunotherapy

Monocytes are a subtype of leukocyte. Monocytes can differentiate into macrophages and myeloid lineage dendritic cells. Monocytes are associated with the adaptive immune system and serve the main functions of phagocytosis, antigen presentation, and cytokine production. Phagocytosis is the process of uptake cellular material, or entire cells, followed by digestion and destruction of the engulfed cellular material. In several embodiments, monocytes are used in connection with one or more additional engineered cells as disclosed herein. Some embodiments of the methods and compositions described herein relate to a monocyte that includes a tumor-directed CAR, or a nucleic acid encoding the tumor-directed CAR. Several embodiments of the methods and compositions disclosed herein relate to monocytes engineered to express a CAR that targets a tumor marker, for example, CD70, CD19, CD123, Her2, mesothelin, Claudin 6, BCMA, EGFR, among others, and optionally includes a membrane-bound interleukin 15 (mbIL15) domain. Several embodiments of the methods and compositions disclosed herein relate to monocytes engineered to express an activating chimeric receptor that targets a ligand on a tumor cell, for example, MICA, MICB, ULBP1, ULBP2, ULBP3, ULBP4, ULBP5, and ULBP6 (among others) and optionally a membrane-bound interleukin 15 (mbIL15) domain.

Lymphocytes for Immunotherapy

Lymphocytes, the other primary sub-type of leukocyte include T cells (cell-mediated, cytotoxic adaptive immunity), natural killer cells (cell-mediated, cytotoxic innate immunity), and B cells (humoral, antibody-driven adaptive immunity). While B cells are engineered according to several embodiments, disclosed herein, several embodiments also relate to engineered T cells or engineered NK cells (mixtures of T cells and NK cells are used in some embodiments, either from the same donor, or different donors). Several embodiments of the methods and compositions disclosed herein relate to lymphocytes engineered to express a CAR that targets a tumor marker, for example, CD70, CD19, CD123, Her2, mesothelin, Claudin 6, BCMA, EGFR, among others, and optionally includes a membrane-bound interleukin 15 (mbIL15) domain. Several embodiments of the methods and compositions disclosed herein relate to lymphocytes engineered to express an activating chimeric receptor that targets a ligand on a tumor cell, for example, MICA, MICB, ULBP1, ULBP2, ULBP3, ULBP4, ULBP5, and ULBP6 (among others) and optionally a membrane-bound interleukin 15 (mbIL15) domain.

T Cells for Immunotherapy

T cells are distinguishable from other lymphocytes subtypes (e.g., B cells or NK cells) based on the presence of a T-cell receptor on the cell surface. T cells can be divided into various different subtypes, including effector T cells, helper T cells, cytotoxic T cells, memory T cells, regulatory T cells, natural killer T cell, mucosal associated invariant T cells and gamma delta T cells. In some embodiments, a specific subtype of T cell is engineered. In some embodiments, a mixed pool of T cell subtypes is engineered. In some embodiments, there is no specific selection of a type of T cells to be engineered to express the cytotoxic receptor complexes disclosed herein. In several embodiments, specific techniques, such as use of cytokine stimulation are used to enhance expansion/collection of T cells with a specific marker profile. For example, in several embodiments, activation of certain human T cells, e.g. CD4+ T cells, CD8+ T cells is achieved through use of CD3 and/or CD28 as stimulatory molecules. In several embodiments, there is provided a method of treating or preventing cancer or an infectious disease, comprising administering a therapeutically effective amount of T cells expressing the cytotoxic receptor complex and/or a homing moiety as described herein. In several embodiments, the engineered T cells are autologous cells, while in some embodiments, the T cells are allogeneic cells. Several embodiments of the methods and compositions disclosed herein relate to T cells engineered to express a CAR that targets a tumor marker, for example, CD70, CD19, CD123, Her2, mesothelin, Claudin 6, BCMA, EGFR, among others, and optionally includes a membrane-bound interleukin 15 (mbIL15) domain. Several embodiments of the methods and compositions disclosed herein relate to T cells engineered to express an activating chimeric receptor that targets a ligand on a tumor cell, for example, MICA, MICB, ULBP1, ULBP2, ULBP3, ULBP4, ULBP5, and ULBP6 (among others) and optionally a membrane-bound interleukin 15 (mbIL15) co-stimulatory domain.

NK Cells for Immunotherapy

In several embodiments, there is provided a method of treating or preventing cancer or an infectious disease, comprising administering a therapeutically effective amount of natural killer (NK) cells expressing the cytotoxic receptor complex and/or a homing moiety as described herein. In several embodiments, the engineered NK cells are autologous cells, while in some embodiments, the NK cells are allogeneic cells. In several embodiments, NK cells are preferred because the natural cytotoxic potential of NK cells is relatively high. In several embodiments, it is unexpectedly beneficial that the engineered cells disclosed herein can further upregulate the cytotoxic activity of NK cells, leading to an even more effective activity against target cells (e.g., tumor or other diseased cells). Some embodiments of the methods and compositions described herein relate to NK cells engineered to express a CAR that targets a tumor marker, for example, CD70, CD19, CD123, Her2, mesothelin, Claudin 6, BCMA, EGFR, among others, and optionally includes a membrane-bound interleukin 15 (mbIL15) domain. Several embodiments of the methods and compositions disclosed herein relate to NK cells engineered to express an activating chimeric receptor that targets a ligand on a tumor cell, for example, MICA, MICB, ULBP1, ULBP2, ULBP3, ULBP4, ULBP5, and ULBP6 (among others) and optionally a membrane-bound interleukin 15 (mbIL15) domain. In several embodiments, immortalized NK cells are used and are subject to gene editing and/or engineering, as disclosed herein. In some embodiments, the NK cells are derived from cell line NK-92. NK-92 cells are derived from NK cells, but lack major inhibitory receptors displayed by normal NK cells, while retaining the majority of activating receptors. Some embodiments of NK-92 cells described herein related to NK-92 cell engineered to silence certain additional inhibitory receptors, for example, SMAD3, allowing for upregulation of interferon-γ (IFNγ), granzyme B, and/or perforin production. Additional information relating to the NK-92 cell line is disclosed in WO 1998/49268 and U.S. Patent Application Publication No. 2002/0068044 and incorporated in their entireties herein by reference. NK-92 cells are used, in several embodiments, in combination with one or more of the other cell types disclosed herein. For example, in one embodiment, NK-92 cells are used in combination with NK cells as disclosed herein. In an additional embodiment, NK-92 cells are used in combination with T cells as disclosed herein.

In several embodiments, genetic manipulation of NK cells is employed to further enhance the efficacy and/or persistence of the NK cells. For example, in several embodiments, expression of various markers/proteins is reduced, substantially reduced, or knocked out (eliminated) through gene editing techniques. Depending on the embodiment, this may include gene editing to reduce expression of one or more of a cytokine-inducible SH2-containing protein encoded by a CISH gene, a transforming growth factor beta receptor (e.g., TGFBR2), a Natural Killer Group 2, member A (NKG2A) receptor, a Cbl proto-oncogene B protein encoded by a CBLB gene, a tripartite motif-containing protein 29 protein encoded by a TRIM29 gene, a suppressor of cytokine signaling 2 protein encoded by a SOCS2 gene, a mothers against decapentaplegic homolog 3 (SMAD3) protein encoded by a SMAD3 gene, a MAP kinase-activated protein kinase 3 (MAPKAPK3) protein encoded by a MAPKAPK3 gene, a carcinoembryonic antigen-related cell adhesion molecule 1 (CEACAM1) protein encoded by a CEACAM1 gene, and/or a DNA-damage-inducible transcript 4 (DDIT4) protein encoded by a DDIT4 gene. In several embodiments, reduced expression is accomplished through targeted introduction of DNA breakage, and subsequent DNA repair mechanism. In several embodiments, double strand breaks of DNA are repaired by non-homologous end joining (NHEJ), wherein enzymes are used to directly join the DNA ends to one another to repair the break. In several embodiments, however, double strand breaks are repaired by homology directed repair (HDR), which is advantageously more accurate, thereby allowing sequence specific breaks and repair. HDR uses a homologous sequence as a template for regeneration of missing DNA sequences at the break point, such as a vector with the desired genetic elements (e.g., an insertion element to disrupt the coding sequence of the target protein, such as CD70 and/or CISH) within a sequence that is homologous to the flanking sequences of a double strand break. This will result in the desired change (e.g., insertion) being inserted at the site of the DSB.

In several embodiments, gene editing is accomplished by one or more of a variety of engineered nucleases. In several embodiments, restriction enzymes are used, particularly when double strand breaks are desired at multiple regions. In several embodiments, a bioengineered nuclease is used. Depending on the embodiment, one or more of a Zinc Finger Nuclease (ZFN), transcription-activator like effector nuclease (TALEN), meganuclease and/or clustered regularly interspaced short palindromic repeats (CRISPR/Cas9) system are used to specifically edit the genes encoding one or more target proteins, such as CD70 and/or CISH.

Meganucleases are characterized by their capacity to recognize and cut large DNA sequences (from 14 to 40 base pairs). In several embodiments, a meganuclease from the LAGLIDADG family is used, and is subjected to mutagenesis and screening to generate a meganuclease variant that recognizes a unique sequence(s), such as a specific site in a gene encoding a target protein of interest. In several embodiments, two or more meganucleases, or functions fragments thereof, are fused to create a hybrid enzymes that recognize a desired target sequence within the gene encoding a target protein of interest, such as CD70 and/or CISH.

In contrast to meganucleases, ZFNs and TALEN function based on a non-specific DNA cutting catalytic domain which is linked to specific DNA sequence recognizing peptides such as zinc fingers or transcription activator-like effectors (TALEs). Advantageously, the ZFNs and TALENs thus allow sequence-independent cleavage of DNA, with a high degree of sequence-specificity in target recognition. Zinc finger motifs naturally function in transcription factors to recognize specific DNA sequences for transcription. The C-terminal part of each finger is responsible for the specific recognition of the DNA sequence. While the sequences recognized by ZFNs are relatively short, (e.g., ~3 base pairs), in several embodiments, combinations of 2, 3, 4, 5, 6, 7, 8, 9, 10 or more zinc fingers whose recognition sites have been characterized are used, thereby allowing targeting of specific sequences, such as a portion of the gene encoding a target protein normally expressed by NK cells, such as CD70 and/or CISH. The combined ZFNs are then fused with the catalytic domain(s) of an endonuclease, such as FokI (optionally a FokI heterodimer), in order to induce a targeted DNA break. Additional information on uses of ZFNs to edit a target gene of interest, such as CD70 or CISH can be found in U.S. Pat. No. 9,597,357, which is incorporated by reference herein.

Transcription activator-like effector nucleases (TALENs) are specific DNA-binding proteins that feature an array of 33 or 34-amino acid repeats. Like ZFNs, TALENs are a fusion of a DNA cutting domain of a nuclease to TALE domains, which allow for sequence-independent introduction of double stranded DNA breaks with highly precise target site recognition. TALENs can create double strand breaks at the target site that can be repaired by error-prone non-homologous end-joining (NHEJ), resulting in gene disruptions through the introduction of small insertions or deletions. Advantageously, TALENs are used in several embodiments, at least in part due to their higher specificity in DNA binding, reduced off-target effects, and ease in construction of the DNA-binding domain.

CRISPRs (Clustered Regularly Interspaced Short Palindromic Repeats) are genetic elements that bacteria use as protection against viruses. The repeats are short sequences that originate from viral genomes and have been incorporated into the bacterial genome. Cas (CRISPR associated proteins) process these sequences and cut matching viral DNA sequences. By introducing plasmids containing Cas genes and specifically constructed CRISPRs into eukaryotic cells, the eukaryotic genome can be cut at any desired position. Additional information on CRISPR can be found in US Patent Publication No. 2014/0068797, which is incorporated by reference herein. In several embodiments, CRISPR is used to manipulate the genes encoding on or more of the TCRs of a T cell and/or the genes encoding one or more immune checkpoint inhibitors. In several embodiments, the immune checkpoint inhibitor is selected from one or more of CTLA4 and PD1. In several embodiments, native CD70 expression by NK cells is disrupted or substantially eliminated by targeting the CD70 encoding gene with a CRISPR/Cas system. In several embodiments, one or more additional target proteins, normally expressed by an NK cells is disrupted or substantially eliminated by targeting the corresponding encoding gene with a CRISPR/Cas system. Depending on the embodiment, one or more of a cytokine-inducible SH2-containing protein encoded by a CISH gene, a transforming growth factor beta receptor (e.g., TGFBR2), a Natural Killer Group 2, member A (NKG2A) receptor, a Cbl proto-oncogene B protein encoded by a CBLB gene, a tripartite motif-containing protein 29 protein encoded by a TRIM29 gene, a suppressor of cytokine signaling 2 protein encoded by a SOCS2 gene, a SMAD3 protein encoded by a SMAD3 gene, a MAPKAPK3 protein encoded by a MAPKAPK3 gene, a CEACAM1 protein encoded by a CEACAM1 gene, and/or a DDIT4 protein encoded by a DDIT4 gene is targeted with a CRISPR/Cas system. Depending on the embodiment, a Class 1 or Class 2 Cas is used. In several embodiments, a Class 1 Cas is used, and the Cas type is selected from the following types: I, IA, IB, IC, ID, IE, IF, IU, III, IIIA, IIIB, IIIC, IIID, IV IVA, IVB, and combinations thereof. In several embodiments, the Cas is selected from the group consisting of Cas3, Cas8a, Cas5, Cas8b, Cas8c, Cas10d, Cse1, Cse2, Csy1, Csy2, Csy3, GSU0054, Cas10, Csm2, Cmr5, Cas10, Csx11, Csx10, Csf1, and combinations thereof. In several embodiments, a Class 2 Cas is used, and the Cas type is selected from the following types: II, IIA, IIB, IIC, V, VI, and combinations thereof. In several embodiments, the Cas is selected from the group consisting of Cas9, Csn2, Cas4, Cpf1, C2c1, C2c3, Cas13a (previously known as C2c2), Cas13b, Cas13c, CasX, CasY and combinations thereof. In some embodiments, class 2 CasX is used, wherein CasX is capable of forming a complex with a guide nucleic acid and wherein the complex can bind to a target DNA, and wherein the target DNA comprises a non-target strand and a target strand. In some embodiments, class 2 CasY is used, wherein CasY is capable of binding and modifying a target nucleic acid and/or a polypeptide associated with target nucleic acid.

Hematopoietic Stem Cells for Cancer Immunotherapy

In some embodiments, hematopoietic stem cells (HSCs) are used in the methods of immunotherapy disclosed herein. In several embodiments, the cells are engineered to express a homing moiety and/or a cytotoxic receptor complex. HSCs are used, in several embodiments, to leverage their ability to engraft for long-term blood cell production, which could result in a sustained source of targeted anti-cancer effector cells, for example to combat cancer remissions. In several embodiments, this ongoing production helps to offset anergy or exhaustion of other cell types, for example due to the tumor microenvironment. In several embodiments allogeneic HSCs are used, while in some embodiments, autologous HSCs are used. In several embodiments, HSCs are used in combination with one or more additional engineered cell type disclosed herein. Some embodiments of the methods and compositions described herein relate to a stem cell, such as a hematopoietic stem cell engineered to express a CAR that targets a tumor marker, for example, CD70, CD19, CD123, CD70, Her2, mesothelin, Claudin 6, BCMA, EGFR, among others, and optionally includes a membrane-bound interleukin 15 (mbIL15) domain. Several embodiments of the methods and compositions disclosed herein relate to hematopoietic stem cells engineered to express an activating chimeric receptor that targets a ligand on a tumor cell, for example, MICA, MICB, ULBP1, ULBP2, ULBP3, ULBP4, ULBP5, and ULBP6 (among others) and optionally includes a membrane-bound interleukin 15 (mbIL15) domain.

Induced Pluripotent Stem Cells

In some embodiments, induced pluripotent stem cells (iPSCs) are used in the method of immunotherapy disclosed herein. iPSCs are used, in several embodiments, to leverage their ability to differentiate and derive into non-pluripotent cells, including, but not limited to, CD34 cells, hemogenic endothelium cells, HSCs (hematopoietic stem and progenitor cells), hematopoietic multipotent progenitor cells, T cell progenitors, NK cell progenitors, T cells, NKT cells, NK cells, and B cells comprising one or several genetic modifications at selected sites through differentiating iPSCs or less differentiated cells comprising the same genetic modifications at the same selected sites. In several embodiments, the iPSCs are used to generate iPSC-derived NK or T cells. In several embodiments, the cells are engineered to express a homing moiety and/or a cytotoxic receptor complex. In several embodiments, iPSCs are used in combination with one or more additional engineered cell type disclosed herein. Some embodiments of the methods and compositions described herein relate to a stem cell, such as a induced pluripotent stem cell engineered to express a CAR that targets a tumor marker, for example, CD19, CD123, CD70, Her2, mesothelin, Claudin 6, BCMA, EGFR, among any of the others disclosed herein, and optionally a membrane-bound interleukin 15 (mbIL15) co-stimulatory domain. Several embodiments of the methods and compositions disclosed herein relate to induced pluripotent stem cells engineered to express an activating chimeric receptor that targets a ligand on a tumor cell, for example, MICA, MICB, ULBP1, ULBP2, ULBP3, ULBP4, ULBP5, and ULBP6 (among others) and optionally a membrane-bound interleukin 15 (mbIL15) co-stimulatory domain.

Genetic Engineering of Immune Cells

As discussed above, a variety of cell types can be utilized in cellular immunotherapy. Further, as elaborated on in more detail below, and shown in the Examples, genetic modifications can be made to these cells in order to enhance one or more aspects of their efficacy (e.g., cytotoxicity) and/or persistence (e.g., active life span). As discussed herein, in several embodiments NK cells are used for immunotherapy. In several embodiments provided for herein, gene editing of an NK cells imparts to the cell various beneficial characteristics such as, for example, enhanced proliferation, enhanced cytotoxicity, and/or enhanced persistence. In several embodiments provided for herein, gene editing of the NK cell can advantageously impart to the edited NK cell the ability to resist and/or overcome various inhibitory signals that are generated in the tumor microenvironment. It is known that tumors generate a variety of signaling molecules that are intended to reduce the anti-tumor effects of immune cells. As discussed in more detail below, in several embodiments, gene editing of the NK cell limits this tumor microenvironment suppressive effect on the NK cells, T cells, combinations of NK and T cells, or any edited/engineered immune cell provided for herein.

As discussed below, in several embodiments, gene editing is employed to reduce or knockout expression of target proteins, for example by disrupting the underlying gene encoding the protein. In several embodiments, gene editing can reduce expression of a target protein by about 30%, about 40%, about 50%, about 60%, about 70%, about 75%, about 80%, about 85%, about 90%, about 95%, about 97%, about 98%, about 99%, or more (including any amount between those listed). In several embodiments, the gene is completely knocked out, such that expression of the target protein is undetectable. In several embodiments, gene editing is used to "knock in" or otherwise enhance expression of a target protein. In several embodiments, expression of a target protein can be enhanced by about 30%, about 40%, about 50%, about 60%, about 70%, about 75%, about 80%, about 85%, about 90%, about 95%, about 97%, about 98%, about 99%, or more (including any amount between those listed).

In accordance with additional embodiments, other modulators of one or more aspects of NK cell (or T cell) function are modulated through gene editing. A variety of cytokines impart either negative (as with TGF-beta above) or positive signals to immune cells. By way of non-limiting example, IL15 is a positive regulator of NK cells, which as disclosed herein, can enhance one or more of NK cell homing, NK cell migration, NK cell expansion/proliferation, NK cell cytotoxicity, and/or NK cell persistence. To keep NK cells in check under normal physiological circumstances, a cytokine-inducible SH2-containing protein (CIS, encoded by the CISH gene) acts as a critical negative regulator of IL-15 signaling in NK cells. As discussed herein, because IL15 biology impacts multiple aspects of NK cell functionality, including, but not limited to, proliferation/expansion, activation, cytotoxicity, persistence, homing, migration, among others. Thus, according to several embodiments, editing CISH enhances the functionality of NK cells across multiple functionalities, leading to a more effective and long-lasting NK cell therapeutic. In several embodiments, inhibitors of CIS are used in conjunction with engineered NK cell administration. In several embodiments, the CIS expression is knocked down or knocked out through gene editing of the CISH gene, for example, by use of CRISPR-Cas editing. Small interfering RNA, antisense RNA, TALENs or zinc fingers are used in other embodiments. In some embodiments CIS expression in T cells is knocked down through gene editing.

In several embodiments, CISH gene editing endows an NK cell with enhanced ability to home to a target site. In several embodiments, CISH gene editing endows an NK cell with enhanced ability to migrate, e.g., within a tissue in response to, for example chemoattractants or away from repellants. In several embodiments, CISH gene editing endows an NK cell with enhanced ability to be activated, and thus exert, for example, anti-tumor effects. In several embodiments, CISH gene editing endows an NK cell with enhanced proliferative ability, which in several embodiments, allows for generation of robust NK cell numbers from a donor blood sample. In addition, in such embodiments, NK cells edited for CISH and engineered to express a CAR are more readily, robustly, and consistently expanded in culture. In several embodiments, CISH gene editing endows an NK cell with enhanced cytotoxicity. In several embodiments, the editing of CISH synergistically enhances the cytotoxic effects of engineered NK cells and/or engineered T cells that express a CAR.

In several embodiments, CISH gene editing activates or inhibits a wide variety of pathways. The CIS protein is a negative regulator of IL15 signaling by way of, for example, inhibiting JAK-STAT signaling pathways. These pathways would typically lead to transcription of IL15-responsive genes (including CISH). In several embodiments, knockdown of CISH disinhibits JAK-STAT (e.g., JAK1-STAT5) signaling and there is enhanced transcription of IL15-responsive genes. In several embodiments, knockout of CISH yields enhanced signaling through mammalian target of rapamycin (mTOR), with corresponding increases in expression of genes related to cell metabolism and respiration. In several embodiments, knockout of CISH yields IL15 induced increased expression of IL-2Rα (CD25), but not IL-15Rα or IL-2/15Rβ, enhanced NK cell membrane binding of IL15 and/or IL2, increased phosphorylation of STAT-3 and/or STAT-5, and elevated expression of the antiapoptotic proteins, such as Bcl-2. In several embodiments, CISH knockout results in IL15-induced upregulation of selected genes related to mitochondrial functions (e.g., electron transport chain and cellular respiration) and cell cycle. Thus, in several embodiments, knockout of CISH by gene editing enhances the NK cell cytotoxicity and/or persistence, at least in part via metabolic reprogramming. In several embodiments, negative regulators of cellular metabolism, such as TXNIP, are downregulated in response to CISH knockout. In several embodiments, promotors for cell survival and proliferation including BIRC5 (Survivin), TOP2A, CKS2, and RACGAP1 are upregulated after CISH knockout, whereas antiproliferative or proapoptotic proteins such as TGFB1, ATM, and PTCH1 are downregulated. In several embodiments, CISH knockout alters the state (e.g., activates or inactivates) signaling via or through one or more of CXCL-10, IL2, TNF, IFNg, IL13, IL4, Jnk, PRF1, STAT5, PRKCQ, IL2 receptor Beta, SOCS2, MYD88, STAT5, STAT1, TBX21, LCK, JAK3, IL& receptor, ABL1, IL9, STAT5A, STAT5B, Tcf7, PRDM1, and/or EOMES.

In several embodiments, gene editing of the immune cells can also provide unexpected enhancement in the expansion, persistence and/or cytotoxicity of the edited immune cell. As disclosed herein, engineered cells (e.g., those expressing a CAR) may also be edited, the combination of which provides for a robust cell for immunotherapy. In several embodiments, the edits allow for unexpectedly improved NK cell expansion, persistence and/or cytotoxicity. In several embodiments, knockout of CISH expression in NK cells removes a potent negative regulator of IL15-mediated signaling in NK cells, disinhibits the NK cells and allows for one or more of enhanced NK cell homing, NK cell migration, activation of NK cells, expansion, cytotoxicity and/or persistence. Additionally, in several embodiments, the editing can enhance NK and/or T cell function in the otherwise suppressive tumor microenvironment. In several embodiments, CISH gene editing results in enhanced NK cell expansion, persistence and/or cytotoxicity without requiring Notch ligand being provided exogenously.

By way of non-limiting example, TGF-beta is one such cytokine released by tumor cells that results in immune suppression within the tumor microenvironment. That immune suppression reduces the ability of immune cells, even engineered CAR-immune cells is some cases, to destroy the tumor cells, thus allowing for tumor progression. In several embodiments, as discussed in detail below, immune checkpoint inhibitors are disrupted through gene editing. In several embodiments, blockers of immune suppressing cytokines in the tumor microenvironment are used, including blockers of their release or competitive inhibitors that reduce the ability of the signaling molecule to bind and inhibit an immune cell. Such signaling molecules include, but are not limited to TGF-beta, IL10, arginase, inducible NOS, reactive-NOS, Arg1, Indoleamine 2,3-dioxygenase (IDO), and $PGE_2$. However, in additional embodiments, there are provided immune cells, such as NK cells, wherein the ability of the NK cell (or other cell) to respond to a given immunosuppressive signaling molecule is disrupted and/or eliminated. For example, in several embodiments, in several embodiments, NK cells or T cells are genetically edited to become have reduced sensitivity to TGF-beta. TGF-beta is an inhibitor of NK cell function on at least the levels of proliferation and cytotoxicity. See, for example, FIG. 8A which schematically shows some of the inhibitory pathways by which TGF-beta reduces NK cell activity and/or proliferation. Thus, according to some embodiments, the expression of the TGF-beta receptor is knocked down or knocked out through gene editing, such that the edited NK is resistant to the immunosuppressive effects of TGF-beta in the tumor microenvironment. In several embodiments, the TGFB2 receptor is knocked down or knocked out through gene editing, for example, by use of CRISPR-Cas editing. Small interfering RNA, antisense RNA, TALENs or zinc fingers are used in other embodiments. Other isoforms of the TGF-beta receptor (e.g., TGF-beta 1 and/or TGF-beta 3) are edited in some embodiments. In some embodiments TGF-beta receptors in T cells are knocked down through gene editing.

Extracellular Domains (Tumor Binder)

Some embodiments of the compositions and methods described herein relate to a chimeric antigen receptor that includes an extracellular domain that comprises a tumor-binding domain (also referred to as an antigen-binding protein or antigen-binding domain) as described herein. The tumor binding domain, depending on the embodiment, targets, for example CD70, CD19, CD123, Her2, mesothelin, Claudin 6, BCMA, EGFR, among others. Several embodiments of the compositions and methods described herein relate to a chimeric receptor that includes an extracellular domain that comprises a ligand binding domain that binds a ligand expressed by a tumor cell (also referred to as an activating chimeric receptor) as described herein. The ligand binding domain, depending on the embodiment, targets for example MICA, MICB, ULBP1, ULBP2, ULBP3, ULBP4, ULBP5, and ULBP6 (among others).

In some embodiments, the antigen-binding domain is derived from or comprises wild-type or non-wild-type sequence of an antibody, an antibody fragment, an scFv, a Fv, a Fab, a (Fab')2, a single domain antibody (SDAB), a vH or vL domain, a camelid VHH domain, or a non-immunoglobulin scaffold such as a DARPIN, an affibody, an affilin, an adnectin, an affitin, a repebody, a fynomer, an alphabody, an avimer, an atrimer, a centyrin, a pronectin, an anticalin, a kunitz domain, an Armadillo repeat protein, an autoantigen, a receptor or a ligand. In some embodiments, the tumor-binding domain contains more than one antigen binding domain.

Antigen-Binding Proteins

There are provided, in several embodiments, antigen-binding proteins. As used herein, the term "antigen-binding protein" shall be given its ordinary meaning, and shall also refer to a protein comprising an antigen-binding fragment that binds to an antigen and, optionally, a scaffold or framework portion that allows the antigen-binding fragment to adopt a conformation that promotes binding of the antigen-binding protein to the antigen. In some embodiments, the antigen is a cancer antigen (e.g., CD70) or a fragment thereof. In some embodiments, the antigen-binding fragment comprises at least one CDR from an antibody that binds to the antigen. In some embodiments, the antigen-binding fragment comprises all three CDRs from the heavy chain of an antibody that binds to the antigen or from the light chain of an antibody that binds to the antigen. In still some embodiments, the antigen-binding fragment comprises all six CDRs from an antibody that binds to the antigen (three from the heavy chain and three from the light chain). In several embodiments, the antigen-binding fragment comprises one, two, three, four, five, or six CDRs from an antibody that binds to the antigen, and in several embodiments, the CDRs can be any combination of heavy and/or light chain CDRs. The antigen-binding fragment in some embodiments is an antibody fragment.

Non-limiting examples of antigen-binding proteins include antibodies, antibody fragments (e.g., an antigen-binding fragment of an antibody), antibody derivatives, and antibody analogs. Further specific examples include, but are not limited to, a single-chain variable fragment (scFv), a nanobody (e.g. VH domain of camelid heavy chain antibodies; VHH fragment), a Fab fragment, a Fab' fragment, a F(ab')2 fragment, a Fv fragment, a Fd fragment, and a complementarity determining region (CDR) fragment. These molecules can be derived from any mammalian source, such as human, mouse, rat, rabbit, or pig, dog, or camelid. Antibody fragments may compete for binding of a target antigen with an intact (e.g., native) antibody and the fragments may be produced by the modification of intact antibodies (e.g. enzymatic or chemical cleavage) or synthesized de novo using recombinant DNA technologies or peptide synthesis. The antigen-binding protein can comprise, for example, an alternative protein scaffold or artificial scaffold with grafted CDRs or CDR derivatives. Such scaffolds include, but are not limited to, antibody-derived scaffolds comprising mutations introduced to, for example, stabilize the three-dimensional structure of the antigen-binding protein as well as wholly synthetic scaffolds comprising, for example, a biocompatible polymer. In addition, peptide antibody mimetics ("PAMs") can be used, as well as scaffolds based on antibody mimetics utilizing fibronectin components as a scaffold.

In some embodiments, the antigen-binding protein comprises one or more antibody fragments incorporated into a single polypeptide chain or into multiple polypeptide chains. For instance, antigen-binding proteins can include, but are not limited to, a diabody; an intrabody; a domain antibody (single VL or VH domain or two or more VH domains joined by a peptide linker); a maxibody (2 scFvs fused to Fc region); a triabody; a tetrabody; a minibody (scFv fused to CH3 domain); a peptibody (one or more peptides attached to an Fc region); a linear antibody (a pair of tandem Fd segments (VH-CH1-VH-CH1) which, together with complementary light chain polypeptides, form a pair of antigen binding regions); a small modular immunopharmaceutical; and immunoglobulin fusion proteins (e.g. IgG-scFv, IgG-Fab, 2scFv-IgG, 4scFv-IgG, VH-IgG, IgG-VH, and Fab-scFv-Fc).

In some embodiments, the antigen-binding protein has the structure of an immunoglobulin. As used herein, the term "immunoglobulin" shall be given its ordinary meaning, and shall also refer to a tetrameric molecule, with each tetramer comprising two identical pairs of polypeptide chains, each pair having one "light" (about 25 kDa) and one "heavy" chain (about 50-70 kDa). The amino-terminal portion of each chain includes a variable region of about 100 to 110 or more amino acids primarily responsible for antigen recognition. The carboxy-terminal portion of each chain defines a constant region primarily responsible for effector function.

Within light and heavy chains, the variable (V) and constant regions (C) are joined by a "J" region of about 12 or more amino acids, with the heavy chain also including a "D" region of about 10 more amino acids. The variable regions of each light/heavy chain pair form the antibody binding site such that an intact immunoglobulin has two binding sites.

Immunoglobulin chains exhibit the same general structure of relatively conserved framework regions (FR) joined by three hypervariable regions, also called complementarity determining regions or CDRs. From N-terminus to C-terminus, both light and heavy chains comprise the domains FR1, CDR1, FR2, CDR2, FR3, CDR3 and FR4.

Human light chains are classified as kappa and lambda light chains. An antibody "light chain", refers to the smaller of the two types of polypeptide chains present in antibody molecules in their naturally occurring conformations. Kappa (K) and lambda (A) light chains refer to the two major antibody light chain isotypes. A light chain may include a polypeptide comprising, from amino terminus to carboxyl terminus, a single immunoglobulin light chain variable region (VL) and a single immunoglobulin light chain constant domain (CL).

Heavy chains are classified as mu (A delta (A), gamma (γ), alpha (a), and epsilon (E), and define the antibody's isotype as IgM, IgD, IgG, IgA, and IgE, respectively. An antibody "heavy chain" refers to the larger of the two types of polypeptide chains present in antibody molecules in their naturally occurring conformations, and which normally determines the class to which the antibody belongs. A heavy chain may include a polypeptide comprising, from amino terminus to carboxyl terminus, a single immunoglobulin heavy chain variable region (VH), an immunoglobulin heavy chain constant domain 1 (CH1), an immunoglobulin hinge region, an immunoglobulin heavy chain constant domain 2 (CH2), an immunoglobulin heavy chain constant domain 3 (CH3), and optionally an immunoglobulin heavy chain constant domain 4 (CH4).

The IgG-class is further divided into subclasses, namely, IgG1, IgG2, IgG3, and IgG4. The IgA-class is further divided into subclasses, namely IgA1 and IgA2. The IgM has subclasses including, but not limited to, IgM1 and IgM2. The heavy chains in IgG, IgA, and IgD antibodies have three domains (CH1, CH2, and CH3), whereas the heavy chains in IgM and IgE antibodies have four domains (CH1, CH2, CH3, and CH4). The immunoglobulin heavy chain constant domains can be from any immunoglobulin isotype, including subtypes. The antibody chains are linked together via inter-polypeptide disulfide bonds between the CL domain and the CH1 domain (e.g., between the light and heavy chain) and between the hinge regions of the antibody heavy chains.

In some embodiments, the antigen-binding protein is an antibody. The term "antibody", as used herein, refers to a protein, or polypeptide sequence derived from an immunoglobulin molecule which specifically binds with an antigen. Antibodies can be monoclonal, or polyclonal, multiple or single chain, or intact immunoglobulins, and may be derived from natural sources or from recombinant sources. Antibodies can be tetramers of immunoglobulin molecules. The antibody may be "humanized", "chimeric" or non-human. An antibody may include an intact immunoglobulin of any isotype, and includes, for instance, chimeric, humanized, human, and bispecific antibodies. An intact antibody will generally comprise at least two full-length heavy chains and two full-length light chains. Antibody sequences can be derived solely from a single species, or can be "chimeric," that is, different portions of the antibody can be derived from two different species as described further below. Unless otherwise indicated, the term "antibody" also includes antibodies comprising two substantially full-length heavy chains and two substantially full-length light chains provided the antibodies retain the same or similar binding and/or function as the antibody comprised of two full length light and heavy chains. For example, antibodies having 1, 2, 3, 4, or 5 amino acid residue substitutions, insertions or deletions at the N-terminus and/or C-terminus of the heavy and/or light chains are included in the definition provided that the antibodies retain the same or similar binding and/or function as the antibodies comprising two full length heavy chains and two full length light chains. Examples of antibodies include monoclonal antibodies, polyclonal antibodies, chimeric antibodies, humanized antibodies, human antibodies, bispecific antibodies, and synthetic antibodies. There is provided, in some embodiments, monoclonal and polyclonal antibodies. As used herein, the term "polyclonal antibody" shall be given its ordinary meaning, and shall also refer to a population of antibodies that are typically widely varied in composition and binding specificity. As used herein, the term "monoclonal antibody" ("mAb") shall be given its ordinary meaning, and shall also refer to one or more of a population of antibodies having identical sequences. Monoclonal antibodies bind to the antigen at a particular epitope on the antigen.

In some embodiments, the antigen-binding protein is a fragment or antigen-binding fragment of an antibody. The term "antibody fragment" refers to at least one portion of an antibody, that retains the ability to specifically interact with (e.g., by binding, steric hindrance, stabilizing/destabilizing, spatial distribution) an epitope of an antigen. Examples of antibody fragments include, but are not limited to, Fab, Fab', F(ab')2, Fv fragments, scFv antibody fragments, disulfide-linked Fvs (sdFv), a Fd fragment consisting of the VH and CHI domains, linear antibodies, single domain antibodies such as sdAb (either vL or vH), camelid vHH domains, multi-specific antibodies formed from antibody fragments such as a bivalent fragment comprising two Fab fragments linked by a disulfide bridge at the hinge region, and an isolated CDR or other epitope binding fragments of an antibody. An antigen binding fragment can also be incorporated into single domain antibodies, maxibodies, minibodies, nanobodies, intrabodies, diabodies, triabodies, tetrabodies, v-NAR and bis-scFv (see, e.g., Hollinger and Hudson, Nature Biotechnology 23: 1126-1136, 2005). Antigen binding fragments can also be grafted into scaffolds based on polypeptides such as a fibronectin type III (Fn3)(see U.S. Pat. No. 6,703,199, which describes fibronectin polypeptide mini bodies). An antibody fragment may include a Fab, Fab', F(ab')2, and/or Fv fragment that contains at least one CDR of an immunoglobulin that is sufficient to confer specific antigen binding to a cancer antigen (e.g., CD19). Antibody fragments may be produced by recombinant DNA techniques or by enzymatic or chemical cleavage of intact antibodies.

In some embodiments, Fab fragments are provided. A Fab fragment is a monovalent fragment having the VL, VH, CL and CH1 domains; a F(ab')2 fragment is a bivalent fragment having two Fab fragments linked by a disulfide bridge at the hinge region; a Fd fragment has the VH and CH1 domains; an Fv fragment has the VL and VH domains of a single arm of an antibody; and a dAb fragment has a VH domain, a VL domain, or an antigen-binding fragment of a VH or VL domain. In some embodiments, these antibody fragments can be incorporated into single domain antibodies, single-chain antibodies, maxibodies, minibodies, intrabodies, diabodies, triabodies, tetrabodies, v-NAR and bis-scFv. In some embodiments, the antibodies comprise at least one CDR as described herein.

There is also provided for herein, in several embodiments, single-chain variable fragments. As used herein, the term "single-chain variable fragment" ("scFv") shall be given its ordinary meaning, and shall also refer to a fusion protein in which a VL and a VH region are joined via a linker (e.g., a synthetic sequence of amino acid residues) to form a continuous protein chain wherein the linker is long enough to allow the protein chain to fold back on itself and form a monovalent antigen binding site). For the sake of clarity, unless otherwise indicated as such, a "single-chain variable fragment" is not an antibody or an antibody fragment as defined herein. Diabodies are bivalent antibodies comprising two polypeptide chains, wherein each polypeptide chain comprises VH and VL domains joined by a linker that is configured to reduce or not allow for pairing between two domains on the same chain, thus allowing each domain to pair with a complementary domain on another polypeptide chain. According to several embodiments, if the two polypeptide chains of a diabody are identical, then a diabody resulting from their pairing will have two identical antigen binding sites. Polypeptide chains having different sequences can be used to make a diabody with two different antigen binding sites. Similarly, tribodies and tetrabodies are antibodies comprising three and four polypeptide chains, respectively, and forming three and four antigen binding sites, respectively, which can be the same or different.

In several embodiments, the antigen-binding protein comprises one or more CDRs. As used herein, the term "CDR" shall be given its ordinary meaning, and shall also refer to the complementarity determining region (also termed "minimal recognition units" or "hypervariable region") within antibody variable sequences. The CDRs permit the antigen-binding protein to specifically bind to a particular antigen of interest. There are three heavy chain variable region CDRs (CDR-H1, CDR-H2 and CDR-H3) and three light chain variable region CDRs (CDR-L1, CDR-L2 and CDR-L3). The CDRs in each of the two chains typically are aligned by the framework regions to form a structure that binds specifically to a specific epitope or domain on the target protein. From N-terminus to C-terminus, naturally-occurring light and heavy chain variable regions both typically conform to the following order of these elements: FW1, CDR1, FW2, CDR2, FW3, CDR3, FW4. For heavy chain variable regions, the order is typically: FW-H1, CDR-H1, FW-H2, CDR-H2, FW-H3, CDR-H3, and FW-H4 from N-terminus to C-terminus. For light chain variable regions, the order is typically: FW-L1, CDR-L1, FW-L2, CDR-L2, FW-L3, CDR-L3, FW-L4 from N-terminus to C-terminus. A numbering system has been devised for assigning numbers to amino acids that occupy positions in each of these domains. This numbering system is defined in Kabat Sequences of Proteins of Immunological Interest (1987 and 1991, NIH, Bethesda, MD), or Chothia & Lesk, 1987, J. Mol. Biol. 196:901-917; Chothia et al., 1989, Nature 342:878-883. Complementarity determining regions (CDRs) and framework regions (FR) of a given antibody may be identified using this system. Other numbering systems for the amino acids in immunoglobulin chains include IMGT® (the international ImMunoGeneTics information system; Lefranc et al, Dev. Comp. Immunol. 29:185-203; 2005) and AHo (Honegger and Pluckthun, J. Mol. Biol. 309(3):657-670; 2001). The binding domains disclosed herein may utilize CDRs defined according to any of these systems. For any given embodiment containing more than one CDR, the CDRs may be defined in accordance with any of Kabat, Chothia, extended, IMGT, Paratome, AbM, and/or conformational definitions, or a combination of any of the foregoing. Any of the CDRs, either separately or within the context of variable domains, can be interpreted by one of skill in the art under any of these numbering systems as appropriate. One or more CDRs may be incorporated into a molecule either covalently or noncovalently to make it an antigen-binding protein.

In some embodiments, the antigen-binding proteins provided herein comprise one or more CDR(s) as part of a larger polypeptide chain. In some embodiments, the antigen-binding proteins covalently link the one or more CDR(s) to another polypeptide chain. In some embodiments, the antigen-binding proteins incorporate the one or more CDR(s) noncovalently. In some embodiments, the antigen-binding proteins may comprise at least one of the CDRs described herein incorporated into a biocompatible framework structure. In some embodiments, the biocompatible framework structure comprises a polypeptide or portion thereof that is sufficient to form a conformationally stable structural support, or framework, or scaffold, which is able to display one or more sequences of amino acids that bind to an antigen (e.g., CDRs, a variable region, etc.) in a localized surface region. Such structures can be a naturally occurring polypeptide or polypeptide "fold" (a structural motif), or can have one or more modifications, such as additions, deletions and/or substitutions of amino acids, relative to a naturally occurring polypeptide or fold. Depending on the embodiment, the scaffolds can be derived from a polypeptide of a variety of different species (or of more than one species), such as a human, a non-human primate or other mammal, other vertebrate, invertebrate, plant, bacteria or virus.

The term "consensus sequence" as used herein with regard to sequences refers to the generalized sequence representing all of the different combinations of permissible amino acids at each location of a group of sequences. A consensus sequence may provide insight into the conserved regions of related sequences where the unit (e.g. amino acid or nucleotide) is the same in most or all of the sequences, and regions that exhibit divergence between sequences. In the case of antibodies, the consensus sequence of a CDR may indicate amino acids that are important or dispensable for antigen binding. It is envisioned that consensus sequences may be prepared with any of the sequences provided herein, and the resultant various sequences derived from the consensus sequence can be validated to have similar effects as the template sequences.

In some embodiments, the antibody or binding fragment thereof comprises a combination of a CDR-H1, CDR-H2, CDR-H3, CDR-L1, CDR-L2, and a CDR-L3 where one or more of these CDRs is defined by a consensus sequence. The consensus sequences provided herein have been derived from the alignments of CDRs provided for herein. However, it is envisioned that alternative alignments may be done (e.g. using global or local alignment, or with different algorithms, such as Hidden Markov Models, seeded guide trees, Needleman-Wunsch algorithm, or Smith-Waterman algorithm) and as such, alternative consensus sequences can be derived.

In some embodiments, the CDR-H1 is defined by the formula $X_1TFX_4X_5X_6X_7X_8X_9$ (SEQ ID NO: 1202), where $X_1$ is G or Y; $X_4$ is R or T; $X_5$ is D, E, N, or S; $X_6$ is N or Y; $X_7$ is A, D, E, G, or Y; $X_8$ is I, L, or M; and $X_9$ is H, N, or S. In some embodiments, the CDR-H1 comprises a sequence having at least 80%, 81%, 82%, 83%, 84%, 85%, 86%, 87%, 88%, 89%, 90%, 91%, 92%, 93%, 94%, 95%, 96%, 97%, 98%, 99%, or 100% identity to this consensus sequence. In some embodiments, the CDR-H1 comprises a sequence having 0, 1, 2, 3, 4, 5, or 6 substitutions from this consensus sequence.

In some embodiments, the CDR-H2 is defined by the formula $GX_2X_3X_4X_5X_6X_7GX_9X_{10}X_{11}YA$ (SEQ ID NO: 1203), where $X_2$ is G, I, V, or W; $X_3$ is I or M; $X_4$ is I, N, or S; $X_5$ is A or P; $X_6$ is I, N, S, or Y; $X_7$ is F, G, N, or S; $X_9$ is A, D, G, H, N, S or T; $X_{10}$ is A or T; and $X_{11}$ or G, I, N, or S. In some embodiments, the CDR-H2 comprises a sequence having at least 80%, 81%, 82%, 83%, 84%, 85%, 86%, 87%, 88%, 89%, 90%, 91%, 92%, 93%, 94%, 95%, 96%, 97%, 98%, 99%, or 100% identity to this consensus sequence. In some embodiments, the CDR-H2 comprises a sequence having 0, 1, 2, 3, 4, 5, or 6 substitutions from this consensus sequence.

In some embodiments, the CDR-H3 is defined by the formula $CAX_3X_4X_5X_6X_7X_8X_9X_{10}X_{11}X_{12}X_{13}X_{14}X_{15}X_{16}X_{17}X_{18}X_{19}X_{20}W$ (SEQ ID NO: 1204), where $X_1$ is C; $X_2$ is A; $X_3$ is G, K, or R; $X_4$ is D, E, G, S, or Y; $X_5$ is F, H, I, M, P, R, S, W, or Y; $X_6$ is G, S, or V; $X_7$ is no amino acid, A, D, G, or V; $X_8$ is no amino acid, A, G, N, W, or Y; $X_9$ is no amino acid, A, P, T, or Y; $X_{10}$ is no amino acid, A, E, G, H, R, or Y; $X_{11}$ is no amino acid, A, D, G, H, or S; $X_{12}$ is no amino acid, D, F, G, or W; $X_{13}$ is no amino acid, A, D, E, G, V, or Y; $X_{14}$ is no amino acid, F, M, or Y; $X_{15}$ is no amino acid or Y; $X_{16}$ is no amino acid or Y; $X_{17}$ is no amino acid or G; $X_{18}$ is no amino acid or M; $X_{19}$ is D or G; and $X_{20}$ is I, L, V, or Y. In some embodiments, the CDR-H3 comprises a sequence having at least 80%, 81%, 82%, 83%, 84%, 85%, 86%, 87%, 88%, 89%, 90%, 91%, 92%, 93%, 94%, 95%, 96%, 97%, 98%, 99%, or 100% identity to this consensus sequence. In some embodiments, the CDR-H3 comprises a sequence having 0, 1, 2, 3, 4, 5, or 6 substitutions from this consensus sequence.

In some embodiments, the CDR-L1 is defined by the formula $X_1ASQX_5X_6X_7X_8X_9LX_{11}$ (SEQ ID NO: 1205), where $X_1$ is Q or R; $X_5$ is D, G, S, or T; $X_6$ is I or V; $X_7$ is G, R, or S; $X_8$ is N, R, or S; $X_9$ is F, W, or Y; and $X_1$ is A or N. In some embodiments, the CDR-L1 comprises a sequence having at least 80%, 81%, 82%, 83%, 84%, 85%, 86%, 87%, 88%, 89%, 90%, 91%, 92%, 93%, 94%, 95%, 96%, 97%, 98%, 99%, or 100% identity to this consensus sequence. In some embodiments, the CDR-L1 comprises a sequence having 0, 1, 2, 3, 4, 5, or 6 substitutions from this consensus sequence.

In some embodiments, the CDR-L2 is defined by the formula $X_1X_2SX_4X_5X_6X_7$ (SEQ ID NO: 1206), where $X_1$ is A, D, or G; $X_2$ is A or T; $X_4$ is D, N, S, or T; $X_5$ is L or R; $X_6$ is A, E, or Q; and $X_7$ is A, N, S or T. In some embodiments, the CDR-L2 comprises a sequence having at least 80%, 81%, 82%, 83%, 84%, 85%, 86%, 87%, 88%, 89%, 90%, 91%, 92%, 93%, 94%, 95%, 96%, 97%, 98%, 99%, or 100% identity to this consensus sequence. In some embodiments, the CDR-L2 comprises a sequence having 0, 1, 2, 3, 4, 5, or 6 substitutions from this consensus sequence.

In some embodiments, the CDR-L3 is defined by the formula $CQQX_4X_5X_6X_7X_8X_9X_{10}X_{11}$ (SEQ ID NO: 1207), where $X_4$ is A, S, or Y; $X_5$ is D, H, I, or Y; $X_6$ is N, S, or T; $X_7$ is A, F, P, S, or T; $X_8$ is L or P; $X_9$ is L, S, T, V, W, or Y; $X_{10}$ is no amino acid, F, or T; and $X_{11}$ is no amino acid or F. In some embodiments, the CDR-L3 comprises a sequence having at least 80%, 81%, 82%, 83%, 84%, 85%, 86%, 87%, 88%, 89%, 90%, 91%, 92%, 93%, 94%, 95%, 96%, 97%, 98%, 99%, or 100% identity to this consensus sequence. In some embodiments, the CDR-L3 comprises a sequence having 0, 1, 2, 3, 4, 5, or 6 substitutions from this consensus sequence.

In some embodiments, the CDR-H1 is defined by the formula $X_1X_2X_3X_4X_5X_6X_7X_8X_9X_{10}X_{11}X_{12}$ (SEQ ID NO: 1208), where $X_1$ is F, G, N or Y; $X_2$ is I, R, S, T, or V; $X_3$ is F or L; $X_4$ is A, D, I, N, R, S, or T; $X_5$ is A, D, E, G, N, R, S, or T; $X_6$ is no amino acid H, S, or Y; $X_7$ is no amino acid, A, D, G, T, or V; $X_8$ is no amino acid D, F, I, or M; $X_9$ is H, N, Q, S, or Y; $X_{10}$ is no amino acid, A, E, F, G, H, L, S, or Y; $X_{11}$ is no amino acid, I, L, M, T, or V; and $X_{12}$ is no amino acid, H, or Y. In some embodiments, the CDR-H1 comprises a sequence having at least 80%, 81%, 82%, 83%, 84%, 85%, 86%, 87%, 88%, 89%, 90%, 91%, 92%, 93%, 94%, 95%, 96%, 97%, 98%, 99%, or 100% identity to this consensus sequence. In some embodiments, the CDR-H1 comprises a sequence having 0, 1, 2, 3, 4, 5, or 6 substitutions from this consensus sequence.

In some embodiments, the CDR-H2 is defined by the formula $X_2X_3X_4X_5X_6X_7X_8X_9X_{10}X_{11}X_{12}X_{13}X_{14}$ (SEQ ID NO: 1209), where $X_1$ is A, G, or S; $X_2$ is A, G, I, M, R, S, T, V, or W; $X_3$ is no amino acid, F, I, M, or V; $X_4$ is D, I, N, S, or T; $X_5$ is A, K, P, S, or T; $X_6$ is D, G, H, I, M, N, R, S, T, or Y; $X_7$ is A, D, F, G, N, S, or T; $X_8$ is A, or G; $X_9$ is A, D, G, H, I, K, N, R, S, T, V, or Y; $X_{10}$ is A, E, N, P, S, or T; $X_{11}$ is A, D, G, H, I, K, L, N, Q, S, T, or Y; $X_{12}$ is F, N, or Y; $X_{13}$ is A or Y; and $X_{14}$ is no amino acid, A, or V. In some embodiments, the CDR-H2 comprises a sequence having at least 80%, 81%, 82%, 83%, 84%, 85%, 86%, 87%, 88%, 89%, 90%, 91%, 92%, 93%, 94%, 95%, 96%, 97%, 98%, 99%, or 100% identity to this consensus sequence. In some embodiments, the CDR-H2 comprises a sequence having 0, 1, 2, 3, 4, 5, or 6 substitutions from this consensus sequence.

In some embodiments, the CDR-H3 is defined by the formula $X_2X_3X_4X_5X_6X_7X_8X_9X_{10}X_{11}X_{12}X_{13}X_{14}X_{15}X_{16}X_{17}X_{18}X_{19}X_{20}X_{21}X_{22}X_{23}X_{24}X_{25}X_{26}X_{27}W$ (SEQ ID NO: 1210), where $X_1$ is no amino acid or C; $X_2$ is no amino acid, A, or C; $X_3$ is no amino acid, A, C, K, or V; $X_4$ is no amino acid, A, D, G, K, M, R, S, or W; $X_5$ is no amino acid, A, D, E, G, H, T, or V; $X_6$ is no amino acid, C, D, E, F, G, H, L, M, N, P, Q, R, S, T, V, or Y; $X_7$ is no amino acid, A, D, E, G, I, L, M, N, Q, R, S, V, or Y; $X_8$ is no amino acid, A, F, I, L, P, R, T, V, W, or Y; $X_9$ is no amino acid, D, E, or Y; $X_{10}$ is no amino acid, G, S, V, or Y; $X_{11}$ is no amino acid, E, G, I, or S; $X_{12}$ is no amino acid or G; $X_{13}$ is no amino acid, L, or T; $X_{14}$ is no amino acid, D, L, or T; $X_{15}$ is no amino acid, A, C, D, G, H, or P; $X_{16}$ is no amino acid, A, C, F, G, L, M, or Y; $X_{17}$ is no amino acid, A, C, D, E, G, K, N, R, S, T, or V; $X_{18}$ is no amino acid, A, C, D, E, G, I, L, N, P, R, S, T, V, W, or Y; $X_{19}$ is no amino acid, A, D, E, F, G, H, K, L, N, Q, R, S, T, W, or Y; $X_{20}$ is no amino acid, A, C, D, E, G, I, M, P, Q, S, T, V, W, or Y; $X_{21}$ is no amino acid, A, D, E, F, G, H, L, Q, S, V, W, or Y; $X_{22}$ is no amino acid, A, D, E, F, G, H, I, L, M, N, P, Q, S, T, W, or Y; $X_{23}$ is no amino acid, A, D, E, G, H, L, P, S, T, V, W, or Y; $X_{24}$ is no amino acid, A, D, E, F, G, I, L, Q, S, T, V, W, or Y; $X_{25}$ is no amino acid, A, F, I, L, M, S, V, or Y; $X_{26}$ is no amino acid, D, G, L, or V; and $X_{27}$ is I, L, N, P, V, or Y. In some embodiments, the CDR-H3 comprises a sequence having at least 80%, 81%, 82%, 83%, 84%, 85%, 86%, 87%, 88%, 89%, 90%, 91%, 92%, 93%, 94%, 95%, 96%, 97%, 98%, 99%, or 100% identity to this consensus sequence. In some embodiments, the CDR-H3 comprises a sequence having 0, 1, 2, 3, 4, 5, or 6 substitutions from this consensus sequence.

In some embodiments, the CDR-L1 is defined by the formula $X_1X_2SX_4X_5X_6X_7X_8X_9X_{10}X_{11}X_{12}X_{13}X_{14}X_{15}X_{16}X_{17}$ (SEQ ID NO: 1211), where $X_1$ is K, Q, or R; $X_2$ is A, S, or T; $X_4$ is E, H, Q, S, or T; $X_5$ is no amino acid or S; $X_6$ is no amino acid, L, or V; $X_7$ is no amino acid or L; $X_8$ is no amino acid, H, or Y; $X_9$ is no amino acid or S; $X_{10}$ is no amino acid or S; $X_{11}$ is D, E, G, N, R, S, or T; $X_{12}$ is G, I, N, or V; $X_{13}$ is D, G, K, N, R, S, T, or Y; $X_{14}$ is D, G, H, I, K, N, R, S, or T; $X_{15}$ is D, F, G, N, S, W, or Y; $X_{16}$ is L or V; and $X_{17}$ is A, D, G, H, or N. In some embodiments, the CDR-L1 comprises a sequence having at least 80%, 81%, 82%, 83%, 84%, 85%, 86%, 87%, 88%, 89%, 90%, 91%, 92%, 93%, 94%, 95%, 96%, 97%, 98%, 99%, or 100% identity to this consensus sequence. In some embodiments, the CDR-L1 comprises a sequence having 0, 1, 2, 3, 4, 5, or 6 substitutions from this consensus sequence.

In some embodiments, the CDR-L2 is defined by the formula $X_1X_2X_3X_4X_5X_6X_7$ (SEQ ID NO: 1212), where $X_1$ is A, D, E, G, H, L, Q, S, W, or Y; $X_2$ is A, G, T, or V; $X_3$ is S or T; $X_4$ is D, N, S, T, or Y; $X_5$ is L or R; $X_6$ is A, D, E, H, or Q; and $X_7$ is A, G, I, N, R, S, or T. In some embodiments, the CDR-L2 comprises a sequence having at least 80%, 81%, 82%, 83%, 84%, 85%, 86%, 87%, 88%, 89%, 90%, 91%, 92%, 93%, 94%, 95%, 96%, 97%, 98%, 99%, or 100% identity to this consensus sequence. In some embodiments, the CDR-L2 comprises a sequence having 0, 1, 2, 3, 4, 5, or 6 substitutions from this consensus sequence.

In some embodiments, the CDR-L3 is defined by the formula $X_1X_2X_3X_4X_5X_6X_7X_8X_9X_{10}X_{11}$ (SEQ ID NO: 1213), where $X_1$ is C or L; $X_2$ is L, M, Q, or S; $X_3$ is K, Q, or T; $X_4$ is A, D, G, N, S, T, or Y; $X_5$ is A, D, F, H, I, L, N, R, T, or Y; $X_6$ is A, D, E, G, H, I, N, Q, R, S, or T; $X_7$ is A, F, G, I, P, S, T, W, or Y; $X_8$ is L, P, or T; $X_9$ is A, F, I, L, M, P, S, T, V, W, or Y; $X_{10}$ is no amino acid, A, F, H, R, S, or T; and $X_{11}$ is no amino acid or F. In some embodiments, the CDR-L3 comprises a sequence having at least 80%, 81%, 82%, 83%, 84%, 85%, 86%, 87%, 88%, 89%, 90%, 91%, 92%, 93%, 94%, 95%, 96%, 97%, 98%, 99%, or 100% identity to this consensus sequence. In some embodiments, the CDR-L3 comprises a sequence having 0, 1, 2, 3, 4, 5, or 6 substitutions from this consensus sequence.

Depending on the embodiment, the biocompatible framework structures are based on protein scaffolds or skeletons other than immunoglobulin domains. In some such embodiments, those framework structures are based on fibronectin, ankyrin, lipocalin, neocarzinostain, cytochrome b, CP1 zinc finger, PST1, coiled coil, LACI-D1, Z domain and/or tendamistat domains.

There is also provided, in some embodiments, antigen-binding proteins with more than one binding site. In several embodiments, the binding sites are identical to one another while in some embodiments the binding sites are different from one another. For example, an antibody typically has two identical binding sites, while a "bispecific" or "bifunctional" antibody has two different binding sites. The two binding sites of a bispecific antigen-binding protein or antibody will bind to two different epitopes, which can reside on the same or different protein targets. In several embodiments, this is particularly advantageous, as a bispecific chimeric antigen receptor can impart to an engineered cell the ability to target multiple tumor markers. For example, CD70 and an additional tumor marker, such as CD123, CD19, Her2, mesothelin, Claudin 6, BCMA, EGFR, MICA, MICB, ULBP1, ULBP2, ULBP3, ULBP4, ULBP5, and ULBP6, among others, or any other marker disclosed herein or appreciated in the art as a tumor specific antigen or tumor associated antigen can be bound by a bispecific antibody.

As used herein, the term "chimeric antibody" shall be given its ordinary meaning, and shall also refer to an antibody that contains one or more regions from one antibody and one or more regions from one or more other antibodies. In some embodiments, one or more of the CDRs are derived from an anti-cancer antigen antibody (e.g., CD70, CD19, CD123, Her2, mesothelin, PD-L1, Claudin 6, BCMA, EGFR, etc.) antibody. In several embodiments, all of the CDRs are derived from an anti-cancer antigen antibody (such as an anti-CD70 antibody). In some embodiments, the CDRs from more than one anti-cancer antigen antibodies are mixed and matched in a chimeric antibody. For instance, a chimeric antibody may comprise a CDR1 from the light chain of a first anti-cancer antigen antibody, a CDR2 and a CDR3 from the light chain of a second anti-cancer antigen antibody, and the CDRs from the heavy chain from a third anti-cancer antigen antibody. Further, the framework regions of antigen-binding proteins disclosed herein may be derived from one of the same anti-cancer antigen (e.g., CD70, CD123, CD19, Her2, mesothelin, Claudin 6, BCMA, EGFR, etc.) antibodies, from one or more different antibodies, such as a human antibody, or from a humanized antibody. In one example of a chimeric antibody, a portion of the heavy and/or light chain is identical with, homologous to, or derived from an antibody from a particular species or belonging to a particular antibody class or subclass, while the remainder of the chain(s) is/are identical with, homologous to, or derived from an antibody or antibodies from another species or belonging to another antibody class or subclass. Also provided herein are fragments of such antibodies that exhibit the desired biological activity. In some embodiments, the CARs disclosed herein comprise an anti-CD70 binding domain. In some embodiments, the anti-CD70 binding domain is an scFv. In several embodiments, the CARs disclosed herein comprise an scFv as the binder for the tumor antigen. In several embodiments, the scFv is encoded by a polynucleotide comprising a sequence that has at least about 85%, about 90%, about 95%, or more, sequence identity to one or more of SEQ ID NOs: 36-120, 221-229, 1038-1111, 1112-1185. In several embodiments, the scFv comprises an amino acid sequences that has at least about 85%, about 90%, about 95%, or more, sequence identity to one or more of SEQ ID NOs: 230-312, 890-963, and/or 964-1037.

Natural Killer Group Domains that Bind Tumor Ligands

In several embodiments, engineered immune cells such as NK cells are leveraged for their ability to recognize and destroy tumor cells. For example, an engineered NK cell may include a CD70-directed chimeric antigen receptor or a nucleic acid encoding said chimeric antigen receptor (or a CAR directed against, for example, one or more of CD123, CD19, Her2, mesothelin, Claudin 6, BCMA, EGFR, etc.). NK cells express both inhibitory and activating receptors on the cell surface. Inhibitory receptors bind self-molecules expressed on the surface of healthy cells (thus preventing immune responses against "self" cells), while the activating receptors bind ligands expressed on abnormal cells, such as tumor cells. When the balance between inhibitory and activating receptor activation is in favor of activating receptors, NK cell activation occurs and target (e.g., tumor) cells are lysed.

Natural killer Group 2 member D (NKG2D) is an NK cell activating receptor that recognizes a variety of ligands expressed on cells. The surface expression of various NKG2D ligands is generally low in healthy cells but is upregulated upon, for example, malignant transformation. Non-limiting examples of ligands recognized by NKG2D include, but are not limited to, MICA, MICB, ULBP1, ULBP2, ULBP3, ULBP4, ULBP5, and ULBP6, as well as other molecules expressed on target cells that control the cytolytic or cytotoxic function of NK cells. In several embodiments, T cells are engineered to express an extracellular domain to binds to one or more tumor ligands and activate the T cell. For example, in several embodiments, T cells are engineered to express an NKG2D receptor as the binder/activation moiety. In several embodiments, engineered cells as disclosed herein are engineered to express another member of the NKG2 family, e.g., NKG2A, NKG2C, and/or NKG2E. Combinations of such receptors are engineered in some embodiments. Moreover, in several embodiments, other receptors are expressed, such as the Killer-cell immunoglobulin-like receptors (KIRs).

In several embodiments, cells are engineered to express a cytotoxic receptor complex comprising a full length NKG2D as an extracellular component to recognize ligands on the surface of tumor cells (e.g., liver cells). In one embodiment, full length NKG2D has the nucleic acid sequence of SEQ ID NO: 27. In several embodiments, the full length NKG2D, or functional fragment thereof is human NKG2D. Additional information about chimeric receptors for use in the presently disclosed methods and compositions can be found in PCT Patent Publication No. WO/2018/183385, which is incorporated in its entirety by reference herein.

In several embodiments, cells are engineered to express a cytotoxic receptor complex comprising a functional fragment of NKG2D as an extracellular component to recognize ligands on the surface of tumor cells or other diseased cells. In one embodiment, the functional fragment of NKG2D has the nucleic acid sequence of SEQ ID NO: 25. In several embodiments, the fragment of NKG2D has at least 70%, at least 75%, at least 80%, at least 85%, at least 90%, or at least 95% sequence identity with full-length wild-type NKG2D. In several embodiments, the fragment may have one or more additional mutations from SEQ ID NO: 25, but retains, or in some embodiments, has enhanced, ligand-binding function. In several embodiments, the functional fragment of NKG2D comprises the amino acid sequence of SEQ ID NO: 26. In several embodiments, the NKG2D fragment is provided as a dimer, trimer, or other concatemeric format, such embodiments providing enhanced ligand-binding activity. In several embodiments, the sequence encoding the NKG2D fragment is optionally fully or partially codon optimized. In one embodiment, a sequence encoding a codon optimized NKG2D fragment comprises the sequence of SEQ ID NO: 28. Advantageously, according to several embodiments, the functional fragment lacks its native transmembrane or intracellular domains but retains its ability to bind ligands of NKG2D as well as transduce activation signals upon ligand binding. A further advantage of such fragments is that expression of DAP10 to localize NKG2D to the cell membrane is not required. Thus, in several embodiments, the cytotoxic receptor complex encoded by the polypeptides disclosed herein does not comprise DAP10. In several embodiments, immune cells, such as NK or T cells (e.g., non-alloreactive T cells engineered according to embodiments disclosed herein), are engineered to express one or more chimeric receptors that target, for example CD70, CD19, CD123, Her2, mesothelin, Claudin 6, BCMA, EGFR, and an NKG2D ligand, such as MICA, MICB, ULBP1, ULBP2, ULBP3, ULBP4, ULBP5, and/or ULBP6. Such cells, in several embodiments, also co-express mbIL15.

In several embodiments, the cytotoxic receptor complexes are configured to dimerize. Dimerization may comprise homodimers or heterodimers, depending on the embodiment. In several embodiments, dimerization results in improved ligand recognition by the cytotoxic receptor complexes (and hence the NK cells expressing the receptor), resulting in a reduction in (or lack) of adverse toxic effects. In several embodiments, the cytotoxic receptor complexes employ internal dimers, or repeats of one or more component subunits. For example, in several embodiments, the cytotoxic receptor complexes may optionally comprise a first NKG2D extracellular domain coupled to a second NKG2D extracellular domain, and a transmembrane/signaling region (or a separate transmembrane region along with a separate signaling region).

In several embodiments, the various domains/subdomains are separated by a linker such as, a GS3 linker (SEQ ID NOs: 15 and 16, nucleotide and protein, respectively) is used (or a GSn linker). Other linkers used according to various embodiments disclosed herein include, but are not limited to those encoded by SEQ ID NOs: 17, 19, 21 or 23. In several embodiments, other linkers comprise the peptide sequence of one of SEQ ID NOs: 18, 20, 22, 24. This provides the potential to separate the various component parts of the receptor complex along the polynucleotide, which can enhance expression, stability, and/or functionality of the receptor complex.

Cytotoxic Signaling Complex

Some embodiments of the compositions and methods described herein relate to a chimeric receptor, such as a chimeric antigen receptor (e.g., a CAR directed to CD70) or a chimeric receptor directed against an NKG2D ligand, such as MICA, MICB, ULBP1, ULBP2, ULBP3, ULBP4, ULBP5, and/or ULBP6) that includes a cytotoxic signaling complex. As disclosed herein, according to several embodiments, the provided cytotoxic receptor complexes comprise one or more transmembrane and/or intracellular domains that initiate cytotoxic signaling cascades upon the extracellular domain(s) binding to ligands on the surface of target cells.

In several embodiments, the cytotoxic signaling complex comprises at least one transmembrane domain, at least one co-stimulatory domain, and/or at least one signaling domain. In some embodiments, more than one component part makes up a given domain—e.g., a co-stimulatory domain may comprise two subdomains. Moreover, in some embodiments, a domain may serve multiple functions, for example, a transmembrane domain may also serve to provide signaling function.

Transmembrane Domains

Some embodiments of the compositions and methods described herein relate to chimeric receptors (e.g., tumor antigen-directed CARs and/or ligand-directed chimeric receptors) that comprise a transmembrane domain. Some embodiments include a transmembrane domain from NKG2D or another transmembrane protein. In several embodiments in which a transmembrane domain is employed, the portion of the transmembrane protein employed retains at least a portion of its normal transmembrane domain.

In several embodiments, however, the transmembrane domain comprises at least a portion of CD8, a transmembrane glycoprotein normally expressed on both T cells and NK cells. In several embodiments, the transmembrane domain comprises CD8a. In several embodiments, the transmembrane domain is referred to as a “hinge”. In several embodiments, the “hinge” of CD8a has the nucleic acid sequence of SEQ ID NO: 1. In several embodiments, the CD8a hinge is truncated or modified and has at least 70%, at least 75%, at least 80%, at least 85%, at least 90%, at least 95% sequence identity with the CD8a having the sequence of SEQ ID NO: 1. In several embodiments, the “hinge” of CD8a comprises the amino acid sequence of SEQ ID NO: 2. In several embodiments, the CD8a can be truncated or modified, such that it has at least 70%, at least 75%, at least 80%, at least 85%, at least 90%, at least 95% sequence identity with the sequence of SEQ ID NO: 2.

In several embodiments, the transmembrane domain comprises a CD8a transmembrane region. In several embodiments, the CD8a transmembrane domain has the nucleic acid sequence of SEQ ID NO: 3. In several embodiments, the CD8a hinge is truncated or modified and has at least 70%, at least 75%, at least 80%, at least 85%, at least 90%, at least 95% sequence identity with the CD8a having the sequence of SEQ ID NO: 3. In several embodiments, the CD8a transmembrane domain comprises the amino acid sequence of SEQ ID NO: 4. In several embodiments, the CD8a hinge is truncated or modified and has at least 70%, at least 75%, at least 80%, at least 85%, at least 90%, at least 95% sequence identity with the CD8a having the sequence of SEQ ID NO: 4.

Taken together in several embodiments, the CD8 hinge/transmembrane complex is encoded by the nucleic acid sequence of SEQ ID NO: 13. In several embodiments, the CD8 hinge/transmembrane complex is truncated or modified and has at least 70%, at least 75%, at least 80%, at least 85%, at least 90%, at least 95% sequence identity with the CD8 hinge/transmembrane complex having the sequence of SEQ ID NO: 13. In several embodiments, the CD8 hinge/transmembrane complex comprises the amino acid sequence of SEQ ID NO: 14. In several embodiments, the CD8 hinge/transmembrane complex hinge is truncated or modified and has at least 70%, at least 75%, at least 80%, at least 85%, at least 90%, at least 95% sequence identity with the CD8 hinge/transmembrane complex having the sequence of SEQ ID NO: 14.

In some embodiments, the transmembrane domain comprises a CD28 transmembrane domain or a fragment thereof. In several embodiments, the CD28 transmembrane domain comprises the amino acid sequence of SEQ ID NO: 30. In several embodiments, the CD28 transmembrane domain complex hinge is truncated or modified and has at least 70%, at least 75%, at least 80%, at least 85%, at least 90%, at least 95% sequence identity with the CD28 transmembrane domain having the sequence of SEQ ID NO: 30.

Co-Stimulatory Domains

Some embodiments of the compositions and methods described herein relate to chimeric receptors (e.g., tumor antigen-directed CARs and/or tumor ligand-directed chimeric receptors) that comprise a co-stimulatory domain. In addition, the various the transmembrane domains and signaling domain (and the combination transmembrane/signaling domains), additional co-activating molecules can be provided, in several embodiments. These can be certain molecules that, for example, further enhance activity of the immune cells. Cytokines may be used in some embodiments. For example, certain interleukins, such as IL-2 and/or IL-15 as non-limiting examples, are used. In some embodiments, the immune cells for therapy are engineered to express such molecules as a secreted form. In additional embodiments, such co-stimulatory domains are engineered to be membrane bound, acting as autocrine stimulatory molecules (or even as paracrine stimulators to neighboring cells).

In several embodiments, the NK cells disclosed herein are engineered to express interleukin 15 (IL15, IL-15). In some embodiments, the IL15 is expressed from a separate cassette on the construct comprising any one of the CARs disclosed herein. In some embodiments, the IL15 is expressed in the same cassette as any one of the CARs disclosed herein, optionally separated by a cleavage site, for example, a proteolytic cleavage site or a T2A, P2A, E2A, or F2A self-cleaving peptide cleavage site. In some embodiments, the IL15 is a membrane-bound IL15 (mbIL15). In some embodiments, the mbIL15 comprises a native IL15 sequence, such as a human native IL15 sequence, and at least one transmembrane domain. In some embodiments, the native IL15 sequence is encoded by a sequence having at least 85%, at least 90%, at least 95% sequence identity to SEQ ID NO: 11. In some embodiments, the native IL15 sequence comprise a peptide sequence having at least 85%, at least 90%, at least 95% sequence identity to SEQ ID NO: 12. In some embodiments, the at least one transmembrane domain comprises a CD8 transmembrane domain. In some embodiments, the mbIL15 may comprise additional components, such as a leader sequence and/or a hinge sequence. In some embodiments, the leader sequence is a CD8 leader sequence. In some embodiments, the hinge sequence is a CD8 hinge sequence.

In some embodiments, the tumor antigen-directed CARs and/or tumor ligand-directed chimeric receptors are encoded by a polynucleotide that encodes for one or more cytosolic protease cleavage sites. Such sites are recognized and cleaved by a cytosolic protease, which can result in separation (and separate expression) of the various component parts of the receptor encoded by the polynucleotide. In some embodiments, the tumor antigen-directed CARs and/or tumor ligand-directed chimeric receptor are encoded by a polynucleotide that encodes for one or more self-cleaving peptides, for example a T2A cleavage site, a P2A cleavage site, an E2A cleavage site, and/or an F2A cleavage site. As a result, depending on the embodiment, the various constituent parts of an engineered cytotoxic receptor complex can be delivered to an NK cell or T cell in a single vector or by multiple vectors. Thus, as shown schematically, in the Figures, a construct can be encoded by a single polynucleotide, but also include a cleavage site, such that downstream elements of the constructs are expressed by the cells as a separate protein (as is the case in some embodiments with IL-15). In several embodiments, a T2A cleavage site is used. In several embodiments, a T2A cleavage site has the nucleic acid sequence of SEQ ID NO: 9. In several embodiments, T2A cleavage site can be truncated or modified, such that it has at least 70%, at least 75%, at least 80%, at least 85%, at least 90%, at least 95% sequence identity with the sequence of SEQ ID NO: 9. In several embodiments, the T2A cleavage site comprises the amino acid sequence of SEQ ID NO: 10. In several embodiments, the T2A cleavage site is truncated or modified and has at least 70%, at least 75%, at least 80%, at least 85%, at least 90%, at least 95% sequence identity with the T2A cleavage site having the sequence of SEQ ID NO: 10.

In several embodiments, NK cells are engineered to express membrane-bound interleukin 15 (mbIL15). In such embodiments, mbIL15 expression on the NK enhances the cytotoxic effects of the engineered NK cell by enhancing the proliferation and/or longevity of the NK cells. In several embodiments, the mbIL15 is encoded by the same polynucleotide as the CAR. In some embodiments, mbIL15 is encoded by a polynucleotide comprising the sequence of SEQ ID NO: 11 and a sequence that encodes for a transmembrane domain. In some embodiments, mbIL15 comprises the amino acid sequence of SEQ ID NO: 12 functionally coupled to an amino acid sequence of a transmembrane domain. In several embodiments, mbIL15 has the nucleic acid sequence of SEQ ID NO: 1188. In several embodiments, mbIL15 can be truncated or modified, such that it has at least 70%, at least 75%, at least 80%, at least 85%, at least 90%, at least 95% sequence identity with the sequence of SEQ ID NO: 1188. In several embodiments, the mbIL15 comprises the amino acid sequence of SEQ ID NO: 1189. In several embodiments, the mbIL15 is truncated or modified and has at least 70%, at least 75%, at least 80%, at least 85%, at least 90%, at least 95% sequence identity with the mbIL15 having the sequence of SEQ ID NO: 1189. Membrane-bound IL15 sequences are explored in PCT publications WO 2018/183385 and WO 2020/056045, each of which is hereby expressly incorporated by reference in its entirety and pertaining to membrane-bound IL15 sequences.

Signaling Domains

Some embodiments of the compositions and methods described herein relate to a chimeric receptor (e.g., tumor antigen-directed CARs and/or tumor ligand-directed chimeric receptors) that includes a signaling domain. For example, immune cells engineered according to several embodiments disclosed herein may comprise at least one subunit of the CD3 T cell receptor complex (or a fragment thereof). In several embodiments, the signaling domain comprises the CD3zeta subunit. In several embodiments, the CD3zeta is encoded by the nucleic acid sequence of SEQ ID NO: 7. In several embodiments, the CD3zeta can be truncated or modified, such that it has at least 70%, at least 75%, at least 80%, at least 85%, at least 90%, at least 95% sequence identity with the CD3zeta having the sequence of SEQ ID NO: 7. In several embodiments, the CD3zeta domain comprises the amino acid sequence of SEQ ID NO: 8. In several embodiments, the CD3zeta domain is truncated or modified and has at least 70%, at least 75%, at least 80%, at least 85%, at least 90%, at least 95% sequence identity with the CD3zeta domain having the sequence of SEQ ID NO: 8.

In several embodiments, unexpectedly enhanced signaling is achieved through the use of multiple signaling domains whose activities act synergistically. For example, in several embodiments, the signaling domain further comprises an OX40 domain. In several embodiments, the OX40 domain is an intracellular signaling domain. In several embodiments, the OX40 intracellular signaling domain has the nucleic acid sequence of SEQ ID NO: 5. In several embodiments, the OX40 intracellular signaling domain can be truncated or modified, such that it has at least 70%, at least 75%, at least 80%, at least 85%, at least 90%, at least 95% sequence identity with the OX40 having the sequence of SEQ ID NO: 5. In several embodiments, the OX40 intracellular signaling domain comprises the amino acid sequence of SEQ ID NO: 6. In several embodiments, the OX40 intracellular signaling domain is truncated or modified and has at least 70%, at least 75%, at least 80%, at least 85%, at least 90%, at least 95% sequence identity with the OX40 intracellular signaling domain having the sequence of SEQ ID NO: 6. In several embodiments, OX40 is used as the sole transmembrane/signaling domain in the construct, however, in several embodiments, OX40 can be used with one or more other domains. For example, combinations of OX40 and CD3zeta are used in some embodiments. By way of further example, combinations of CD28, OX40, 4-1 BB, and/or CD3zeta are used in some embodiments.

In several embodiments, the signaling domain comprises a 4-1 BB domain. In several embodiments, the 4-1 BB domain is an intracellular signaling domain. In several embodiments, the 4-1 BB intracellular signaling domain comprises the amino acid sequence of SEQ ID NO: 29. In several embodiments, the 4-1 BB intracellular signaling domain is truncated or modified and has at least 70%, at least 75%, at least 80%, at least 85%, at least 90%, at least 95% sequence identity with the 4-1 BB intracellular signaling domain having the sequence of SEQ ID NO: 29. In several embodiments, 4-1 BB is used as the sole transmembrane/signaling domain in the construct, however, in several embodiments, 4-1 BB can be used with one or more other domains. For example, combinations of 4-1 BB and CD3zeta are used in some embodiments. By way of further example, combinations of CD28, OX40, 4-1 BB, and/or CD3zeta are used in some embodiments.

In several embodiments, the signaling domain comprises a CD28 domain. In several embodiments the CD28 domain is an intracellular signaling domain. In several embodiments, the CD28 intracellular signaling domain comprises the amino acid sequence of SEQ ID NO: 31. In several embodiments, the CD28 intracellular signaling domain is truncated or modified and has at least 70%, at least 75%, at least 80%, at least 85%, at least 90%, at least 95% sequence identity with the CD28 intracellular signaling domain having the sequence of SEQ ID NO: 31. In several embodiments, CD28 is used as the sole transmembrane/signaling domain in the construct, however, in several embodiments, CD28 can be used with one or more other domains. For example, combinations of CD28 and CD3zeta are used in some embodiments. By way of further example, combinations of CD28, OX40, 4-1 BB, and/or CD3zeta are used in some embodiments.

Cytotoxic Receptor Complex Constructs

Some embodiments of the compositions and methods described herein relate to chimeric antigen receptors, such as a CD19-directed chimeric receptor, as well as chimeric receptors, such as an activating chimeric receptor (ACR) that targets ligands of NKG2D. The expression of these cytotoxic receptor complexes in immune cells, such as genetically modified non-alloreactive T cells and/or NK cells, allows the targeting and destruction of particular target cells, such as cancerous cells. Non-limiting examples of such cytotoxic receptor complexes are discussed in more detail below.

Chimeric Antigen Receptor Cytotoxic Receptor Complex Constructs

Figure 6:
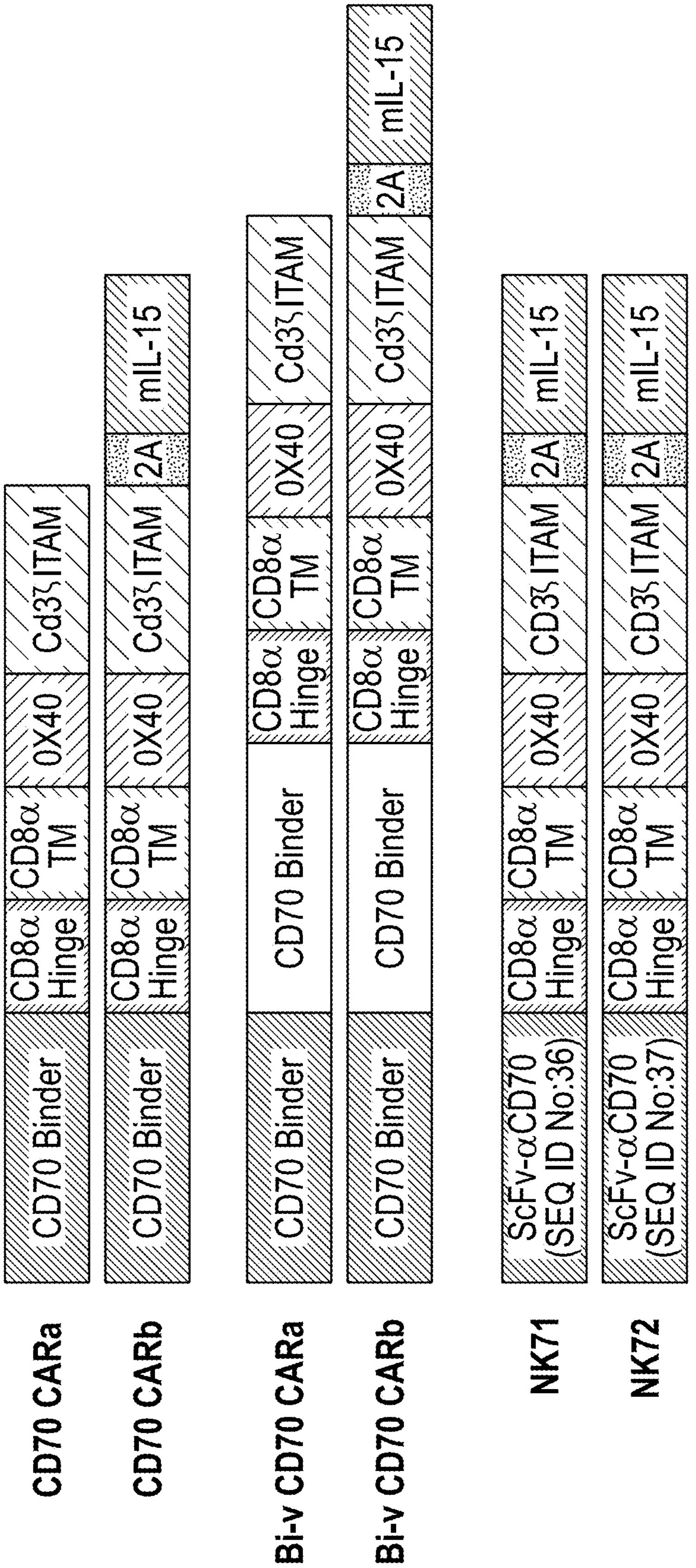
FIG. 6 depicts non-limiting schematics of tumor-directed chimeric antigen receptors directed against non-limiting examples of tumor markers.
Figure 7:
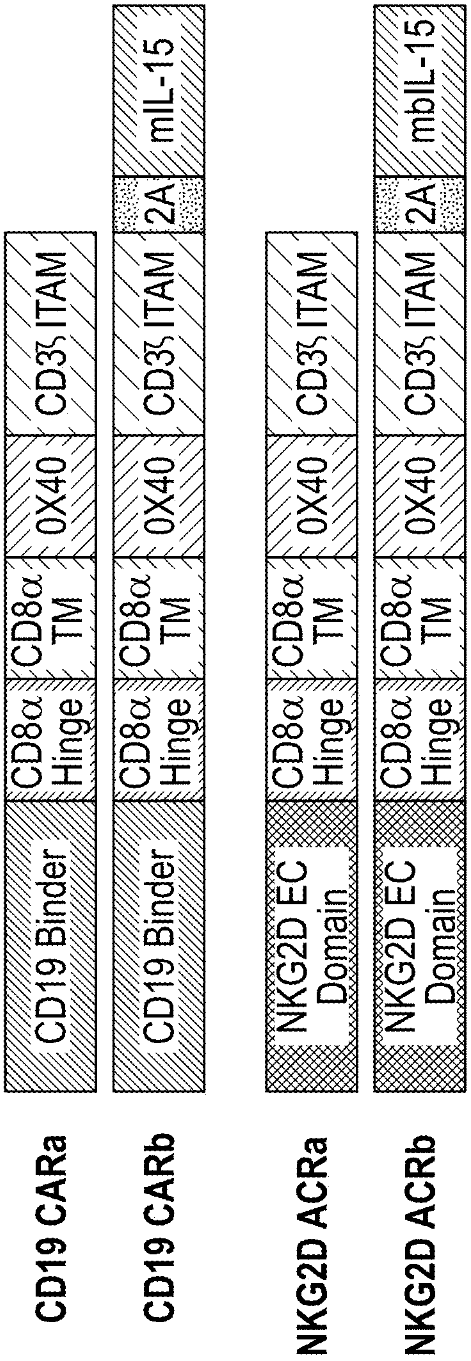
FIG. 7 depicts additional non-limiting schematics of tumor-directed chimeric antigen receptors directed against non-limiting examples of tumor markers.

In several embodiments, there are provided for herein a variety of cytotoxic receptor complexes (also referred to as cytotoxic receptors) are provided for herein with the general structure of a chimeric antigen receptor. FIGS. 1-7 depict non-limiting schematics of constructs that include a tumor binding moiety that binds to tumor antigens or tumor-associated antigens expressed on the surface of cancer cells and activates the engineered cell expressing the chimeric antigen receptor. FIG. 7 shows a schematic of a chimeric receptor complex, with an NKG2D activating chimeric receptor as a non-limiting example (see NKG2D ACRa and ACRb). FIG. 6 shows a schematic of a CD70 directed CAR, as well as a bispecific CD70 CAR/chimeric receptor complex, and two non-limiting constructs, NK71 and NK72, which target CD70.

As shown in the figures, several embodiments of the CAR include an anti-tumor binder, a CD8a hinge domain, an Ig4 SH domain (or hinge), a CD8a transmembrane domain, a CD28 transmembrane domain, an OX40 domain, a 4-1BB domain, a CD28 domain, a CD3 ITAM domain or subdomain, a CD3zeta domain, an NKp80 domain, a CD16 IC domain, a 2A cleavage site, and/or a membrane-bound IL-15 domain (though, as above, in several embodiments soluble IL-15 is used). In several embodiments, the binding and activation functions are engineered to be performed by separate domains. Several embodiments relate to complexes with more than one tumor binder moiety or other binder/activation moiety. In some embodiments, the binder/activation moiety targets other markers besides CD70, such as a cancer target described herein, for example, CD19, CD123, CLDN6, BCMA, HER2, Mesothelin, PD-L1, or EGFR. In several embodiments, a construct is provided that targets NKG2D ligands on tumor cells, which can be used in conjunction with the CARs disclosed herein. In several embodiments, the general structure of the chimeric antigen receptor construct includes a hinge and/or transmembrane domain. These may, in some embodiments, be fulfilled by a single domain, or a plurality of subdomains may be used, in several embodiments. The receptor complex further comprises a signaling domain, which transduces signals after binding of the homing moiety to the target cell, ultimately leading to the cytotoxic effects on the target cell. In several embodiments, the complex further comprises a co-stimulatory domain, which operates, synergistically, in several embodiments, to enhance the function of the signaling domain. Expression of these complexes in immune cells, such as NK cells and/or T cells, allows the targeting and destruction of particular target cells, such as cancerous cells that express a given tumor marker. Some such receptor complexes comprise an extracellular domain comprising an anti-CD70 moiety, or CD70-binding moiety, that binds CD70 on the surface of target cells and activates the engineered cell. The CD3zeta ITAM subdomain may act in concert as a signaling domain. The IL-15 domain, e.g., mbIL-15 domain, may act as a co-stimulatory domain. The IL-15 domain, e.g. mbIL-15 domain, may render immune cells (e.g., NK or T cells) expressing it particularly efficacious against target tumor cells. It shall be appreciated that the IL-15 domain, such as an mbIL-15 domain, can, in accordance with several embodiments, be encoded on a separate construct. Additionally, each of the components may be encoded in one or more separate constructs.

Disclosed herein in some embodiments are anti-CD70 binding domains. In some embodiments, the anti-CD70 binding domains are scFvs. These anti-CD70 binding domains are specific for and/or preferentially bind to CD70. The anti-CD70 binding domains disclosed herein may be incorporated into any one of the chimeric antigen receptor constructs disclosed herein. The anti-CD70 binding domains disclosed herein may furthermore be expressed by a cell, either separately or within an anti-CD70 CAR.

In some embodiments, the anti-CD70 binding domain comprises a polynucleotide sequence that is at least 70%, 75%, 80%, 85%, 90%, 91%, 92%, 93%, 94%, 95%, 96%, 97%, 98%, 99%, or more, or a range defined by any two of the aforementioned percentages, identical to the sequence of either SEQ ID NO: 36 and/or SEQ ID NO: 37.

In some embodiments, the anti-CD70 binding domain comprises a heavy chain variable region and a light chain variable region. In some embodiments, the heavy chain variable region comprises a CDR-H1, CDR-H2, and CDR-H3 and the light chain variable region comprises a CDR-L1, CDR-L2, and CDR-L3. In some embodiments, the CDR-H1 comprises a sequence having at least 75%, 80%, 85%, 90%, 95%, 99%, or 100% sequence identity to a sequence selected from SEQ ID NOs: 428-501; the CDR-H2 comprises a sequence having at least 75%, 80%, 85%, 90%, 95%, 99%, or 100% sequence identity to a sequence selected from SEQ ID NOs: 502-575; the CDR-H3 comprises a sequence having at least 75%, 80%, 85%, 90%, 95%, 99%, or 100% sequence identity to a sequence selected from SEQ ID NOs: 576-649; the CDR-L1 comprises a sequence having at least 75%, 80%, 85%, 90%, 95%, 99%, or 100% sequence identity to a sequence selected from SEQ ID NOs: 668-741; the CDR-L2 comprises a sequence having at least 75%, 80%, 85%, 90%, 95%, 99%, or 100% sequence identity to a sequence selected from SEQ ID NOs: 742-815; and the CDR-L3 comprises a sequence having at least 75%, 80%, 85%, 90%, 95%, 99%, or 100% sequence identity to a sequence selected from SEQ ID NOs: 816-889.

In some embodiments of the anti-CD70 binding domains, the heavy chain variable region comprises an amino acid sequence having at least 75%, 80%, 85%, 90%, 95%, 99%, or 100% sequence identity to any sequence selected from SEQ ID NOs: 890-963. In some embodiments, the light chain variable region comprises an amino acid sequence having at least 75%, 80%, 85%, 90%, 95%, 99%, or 100% sequence identity to any sequence selected from SEQ ID NOs: 964-1037.

In some embodiments of the anti-CD70 binding domains: 1) the heavy chain variable region comprises the CDR-H1, CDR-H2, CDR-H3 within SEQ ID NO: 890 and the light chain variable region comprises the CDR-L1, CDR-L2, CDR-L3 within SEQ ID NO: 964; 2) the heavy chain variable region comprises the CDR-H1, CDR-H2, CDR-H3 within SEQ ID NO: 891 and the light chain variable region comprises the CDR-L1, CDR-L2, CDR-L3 within SEQ ID NO: 965; 3) the heavy chain variable region comprises the CDR-H1, CDR-H2, CDR-H3 within SEQ ID NO: 892 and the light chain variable region comprises the CDR-L1, CDR-L2, CDR-L3 within SEQ ID NO: 966; 4) the heavy chain variable region comprises the CDR-H1, CDR-H2, CDR-H3 within SEQ ID NO: 893 and the light chain variable region comprises the CDR-L1, CDR-L2, CDR-L3 within SEQ ID NO: 967; 5) the heavy chain variable region comprises the CDR-H1, CDR-H2, CDR-H3 within SEQ ID NO: 894 and the light chain variable region comprises the CDR-L1, CDR-L2, CDR-L3 within SEQ ID NO: 968; 6) the heavy chain variable region comprises the CDR-H1, CDR-H2, CDR-H3 within SEQ ID NO: 895 and the light chain variable region comprises the CDR-L1, CDR-L2, CDR-L3 within SEQ ID NO: 969; 7) the heavy chain variable region comprises the CDR-H1, CDR-H2, CDR-H3 within SEQ ID NO: 896 and the light chain variable region comprises the CDR-L1, CDR-L2, CDR-L3 within SEQ ID NO: 970; 8) the heavy chain variable region comprises the CDR-H1, CDR-H2, CDR-H3 within SEQ ID NO: 897 and the light chain variable region comprises the CDR-L1, CDR-L2, CDR-L3 within SEQ ID NO: 971; 9) the heavy chain variable region comprises the CDR-H1, CDR-H2, CDR-H3 within SEQ ID NO: 898 and the light chain variable region comprises the CDR-L1, CDR-L2, CDR-L3 within SEQ ID NO: 972; 10) the heavy chain variable region comprises the CDR-H1, CDR-H2, CDR-H3 within SEQ ID NO: 899 and the light chain variable region comprises the CDR-L1, CDR-L2, CDR-L3 within SEQ ID NO: 973; 11) the heavy chain variable region comprises the CDR-H1, CDR-H2, CDR-H3 within SEQ ID NO: 900 and the light chain variable region comprises the CDR-L1, CDR-L2, CDR-L3 within SEQ ID NO: 974; 12) the heavy chain variable region comprises the CDR-H1, CDR-H2, CDR-H3 within SEQ ID NO: 901 and the light chain variable region comprises the CDR-L1, CDR-L2, CDR-L3 within SEQ ID NO: 975; 13) the heavy chain variable region comprises the CDR-H1, CDR-H2, CDR-H3 within SEQ ID NO: 902 and the light chain variable region comprises the CDR-L1, CDR-L2, CDR-L3 within SEQ ID NO: 976; 14) the heavy chain variable region comprises the CDR-H1, CDR-H2, CDR-H3 within SEQ ID NO: 903 and the light chain variable region comprises the CDR-L1, CDR-L2, CDR-L3 within SEQ ID NO: 977; 15) the heavy chain variable region comprises the CDR-H1, CDR-H2, CDR-H3 within SEQ ID NO: 904 and the light chain variable region comprises the CDR-L1, CDR-L2, CDR-L3 within SEQ ID NO: 978; 16) the heavy chain variable region comprises the CDR-H1, CDR-H2, CDR-H3 within SEQ ID NO: 905 and the light chain variable region comprises the CDR-L1, CDR-L2, CDR-L3 within SEQ ID NO: 979; 17) the heavy chain variable region comprises the CDR-H1, CDR-H2, CDR-H3 within SEQ ID NO: 906 and the light chain variable region comprises the CDR-L1, CDR-L2, CDR-L3 within SEQ ID NO: 980; 18) the heavy chain variable region comprises the CDR-H1, CDR-H2, CDR-H3 within SEQ ID NO: 907 and the light chain variable region comprises the CDR-L1, CDR-L2, CDR-L3 within SEQ ID NO: 981; 19) the heavy chain variable region comprises the CDR-H1, CDR-H2, CDR-H3 within SEQ ID NO: 908 and the light chain variable region comprises the CDR-L1, CDR-L2, CDR-L3 within SEQ ID NO: 982; 20) the heavy chain variable region comprises the CDR-H1, CDR-H2, CDR-H3 within SEQ ID NO: 909 and the light chain variable region comprises the CDR-L1, CDR-L2, CDR-L3 within SEQ ID NO: 983; 21) the heavy chain variable region comprises the CDR-H1, CDR-H2, CDR-H3 within SEQ ID NO: 910 and the light chain variable region comprises the CDR-L1, CDR-L2, CDR-L3 within SEQ ID NO: 984; 22) the heavy chain variable region comprises the CDR-H1, CDR-H2, CDR-H3 within SEQ ID NO: 911 and the light chain variable region comprises the CDR-L1, CDR-L2, CDR-L3 within SEQ ID NO: 985; 23) the heavy chain variable region comprises the CDR-H1, CDR-H2, CDR-H3 within SEQ ID NO: 912 and the light chain variable region comprises the CDR-L1, CDR-L2, CDR-L3 within SEQ ID NO: 986; 24) the heavy chain variable region comprises the CDR-H1, CDR-H2, CDR-H3 within SEQ ID NO: 913 and the light chain variable region comprises the CDR-L1, CDR-L2, CDR-L3 within SEQ ID NO: 987; 25) the heavy chain variable region comprises the CDR-H1, CDR-H2, CDR-H3 within SEQ ID NO: 914 and the light chain variable region comprises the CDR-L1, CDR-L2, CDR-L3 within SEQ ID NO: 988; 26) the heavy chain variable region comprises the CDR-H1, CDR-H2, CDR-H3 within SEQ ID NO: 915 and the light chain variable region comprises the CDR-L1, CDR-L2, CDR-L3 within SEQ ID NO: 989; 27) the heavy chain variable region comprises the CDR-H1, CDR-H2, CDR-H3 within SEQ ID NO: 916 and the light chain variable region comprises the CDR-L1, CDR-L2, CDR-L3 within SEQ ID NO: 990; 28) the heavy chain variable region comprises the CDR-H1, CDR-H2, CDR-H3 within SEQ ID NO: 917 and the light chain variable region comprises the CDR-L1, CDR-L2, CDR-L3 within SEQ ID NO: 991; 29) the heavy chain variable region comprises the CDR-H1, CDR-H2, CDR-H3 within SEQ ID NO: 918 and the light chain variable region comprises the CDR-L1, CDR-L2, CDR-L3 within SEQ ID NO: 992; 30) the heavy chain variable region comprises the CDR-H1, CDR-H2, CDR-H3 within SEQ ID NO: 919 and the light chain variable region comprises the CDR-L1, CDR-L2, CDR-L3 within SEQ ID NO: 993; 31) the heavy chain variable region comprises the CDR-H1, CDR-H2, CDR-H3 within SEQ ID NO: 920 and the light chain variable region comprises the CDR-L1, CDR-L2, CDR-L3 within SEQ ID NO: 994; 32) the heavy chain variable region comprises the CDR-H1, CDR-H2, CDR-H3 within SEQ ID NO: 921 and the light chain variable region comprises the CDR-L1, CDR-L2, CDR-L3 within SEQ ID NO: 995; 33) the heavy chain variable region comprises the CDR-H1, CDR-H2, CDR-H3 within SEQ ID NO: 922 and the light chain variable region comprises the CDR-L1, CDR-L2, CDR-L3 within SEQ ID NO: 996; 34) the heavy chain variable region comprises the CDR-H1, CDR-H2, CDR-H3 within SEQ ID NO: 923 and the light chain variable region comprises the CDR-L1, CDR-L2, CDR-L3 within SEQ ID NO: 997; 35) the heavy chain variable region comprises the CDR-H1, CDR-H2, CDR-H3 within SEQ ID NO: 924 and the light chain variable region comprises the CDR-L1, CDR-L2, CDR-L3 within SEQ ID NO: 998; 36) the heavy chain variable region comprises the CDR-H1, CDR-H2, CDR-H3 within SEQ ID NO: 925 and the light chain variable region comprises the CDR-L1, CDR-L2, CDR-L3 within SEQ ID NO: 999; 37) the heavy chain variable region comprises the CDR-H1, CDR-H2, CDR-H3 within SEQ ID NO: 926 and the light chain variable region comprises the CDR-L1, CDR-L2, CDR-L3 within SEQ ID NO: 1000; 38) the heavy chain variable region comprises the CDR-H1, CDR-H2, CDR-H3 within SEQ ID NO: 927 and the light chain variable region comprises the CDR-L1, CDR-L2, CDR-L3 within SEQ ID NO: 1001; 39) the heavy chain variable region comprises the CDR-H1, CDR-H2, CDR-H3 within SEQ ID NO: 928 and the light chain variable region comprises the CDR-L1, CDR-L2, CDR-L3 within SEQ ID NO: 1002; 40) the heavy chain variable region comprises the CDR-H1, CDR-H2, CDR-H3 within SEQ ID NO: 929 and the light chain variable region comprises the CDR-L1, CDR-L2, CDR-L3 within SEQ ID NO: 1003; 41) the heavy chain variable region comprises the CDR-H1, CDR-H2, CDR-H3 within SEQ ID NO: 930 and the light chain variable region comprises the CDR-L1, CDR-L2, CDR-L3 within SEQ ID NO: 1004; 42) the heavy chain variable region comprises the CDR-H1, CDR-H2, CDR-H3 within SEQ ID NO: 931 and the light chain variable region comprises the CDR-L1, CDR-L2, CDR-L3 within SEQ ID NO: 1005; 43) the heavy chain variable region comprises the CDR-H1, CDR-H2, CDR-H3 within SEQ ID NO: 932 and the light chain variable region comprises the CDR-L1, CDR-L2, CDR-L3 within SEQ ID NO: 1006; 44) the heavy chain variable region comprises the CDR-H1, CDR-H2, CDR-H3 within SEQ ID NO: 933 and the light chain variable region comprises the CDR-L1, CDR-L2, CDR-L3 within SEQ ID NO: 1007; 45) the heavy chain variable region comprises the CDR-H1, CDR-H2, CDR-H3 within SEQ ID NO: 934 and the light chain variable region comprises the CDR-L1, CDR-L2, CDR-L3 within SEQ ID NO: 1008; 46) the heavy chain variable region comprises the CDR-H1, CDR-H2, CDR-H3 within SEQ ID NO: 935 and the light chain variable region comprises the CDR-L1, CDR-L2, CDR-L3 within SEQ ID NO: 1009; 47) the heavy chain variable region comprises the CDR-H1, CDR-H2, CDR-H3 within SEQ ID NO: 936 and the light chain variable region comprises the CDR-L1, CDR-L2, CDR-L3 within SEQ ID NO: 1010; 48) the heavy chain variable region comprises the CDR-H1, CDR-H2, CDR-H3 within SEQ ID NO: 937 and the light chain variable region comprises the CDR-L1, CDR-L2, CDR-L3 within SEQ ID NO: 1011; 49) the heavy chain variable region comprises the CDR-H1, CDR-H2, CDR-H3 within SEQ ID NO: 938 and the light chain variable region comprises the CDR-L1, CDR-L2, CDR-L3 within SEQ ID NO: 1012; 50) the heavy chain variable region comprises the CDR-H1, CDR-H2, CDR-H3 within SEQ ID NO: 939 and the light chain variable region comprises the CDR-L1, CDR-L2, CDR-L3 within SEQ ID NO: 1013; 51) the heavy chain variable region comprises the CDR-H1, CDR-H2, CDR-H3 within SEQ ID NO: 940 and the light chain variable region comprises the CDR-L1, CDR-L2, CDR-L3 within SEQ ID NO: 1014; 52) the heavy chain variable region comprises the CDR-H1, CDR-H2, CDR-H3 within SEQ ID NO: 941 and the light chain variable region comprises the CDR-L1, CDR-L2, CDR-L3 within SEQ ID NO: 1015; 53) the heavy chain variable region comprises the CDR-H1, CDR-H2, CDR-H3 within SEQ ID NO: 942 and the light chain variable region comprises the CDR-L1, CDR-L2, CDR-L3 within SEQ ID NO: 1016; 54) the heavy chain variable region comprises the CDR-H1, CDR-H2, CDR-H3 within SEQ ID NO: 943 and the light chain variable region comprises the CDR-L1, CDR-L2, CDR-L3 within SEQ ID NO: 1017; 55) the heavy chain variable region comprises the CDR-H1, CDR-H2, CDR-H3 within SEQ ID NO: 944 and the light chain variable region comprises the CDR-L1, CDR-L2, CDR-L3 within SEQ ID NO: 1018; 56) the heavy chain variable region comprises the CDR-H1, CDR-H2, CDR-H3 within SEQ ID NO: 945 and the light chain variable region comprises the CDR-L1, CDR-L2, CDR-L3 within SEQ ID NO: 1019; 57) the heavy chain variable region comprises the CDR-H1, CDR-H2, CDR-H3 within SEQ ID NO: 946 and the light chain variable region comprises the CDR-L1, CDR-L2, CDR-L3 within SEQ ID NO: 1020; 58) the heavy chain variable region comprises the CDR-H1, CDR-H2, CDR-H3 within SEQ ID NO: 947 and the light chain variable region comprises the CDR-L1, CDR-L2, CDR-L3 within SEQ ID NO: 1021; 59) the heavy chain variable region comprises the CDR-H1, CDR-H2, CDR-H3 within SEQ ID NO: 948 and the light chain variable region comprises the CDR-L1, CDR-L2, CDR-L3 within SEQ ID NO: 1022; 60) the heavy chain variable region comprises the CDR-H1, CDR-H2, CDR-H3 within SEQ ID NO: 949 and the light chain variable region comprises the CDR-L1, CDR-L2, CDR-L3 within SEQ ID NO: 1023; 61) the heavy chain variable region comprises the CDR-H1, CDR-H2, CDR-H3 within SEQ ID NO: 950 and the light chain variable region comprises the CDR-L1, CDR-L2, CDR-L3 within SEQ ID NO: 1024; 62) the heavy chain variable region comprises the CDR-H1, CDR-H2, CDR-H3 within SEQ ID NO: 951 and the light chain variable region comprises the CDR-L1, CDR-L2, CDR-L3 within SEQ ID NO: 1025; 63) the heavy chain variable region comprises the CDR-H1, CDR-H2, CDR-H3 within SEQ ID NO: 952 and the light chain variable region comprises the CDR-L1, CDR-L2, CDR-L3 within SEQ ID NO: 1026; 64) the heavy chain variable region comprises the CDR-H1, CDR-H2, CDR-H3 within SEQ ID NO: 953 and the light chain variable region comprises the CDR-L1, CDR-L2, CDR-L3 within SEQ ID NO: 1027; 65) the heavy chain variable region comprises the CDR-H1, CDR-H2, CDR-H3 within SEQ ID NO: 954 and the light chain variable region comprises the CDR-L1, CDR-L2, CDR-L3 within SEQ ID NO: 1028; 66) the heavy chain variable region comprises the CDR-H1, CDR-H2, CDR-H3 within SEQ ID NO: 955 and the light chain variable region comprises the CDR-L1, CDR-L2, CDR-L3 within SEQ ID NO: 1029; 67) the heavy chain variable region comprises the CDR-H1, CDR-H2, CDR-H3 within SEQ ID NO: 956 and the light chain variable region comprises the CDR-L1, CDR-L2, CDR-L3 within SEQ ID NO: 1030; 68) the heavy chain variable region comprises the CDR-H1, CDR-H2, CDR-H3 within SEQ ID NO: 957 and the light chain variable region comprises the CDR-L1, CDR-L2, CDR-L3 within SEQ ID NO: 1031; 69) the heavy chain variable region comprises the CDR-H1, CDR-H2, CDR-H3 within SEQ ID NO: 958 and the light chain variable region comprises the CDR-L1, CDR-L2, CDR-L3 within SEQ ID NO: 1032; 70) the heavy chain variable region comprises the CDR-H1, CDR-H2 CDR-H3 within SEQ ID NO: 959 and the light chain variable region comprises the CDR-L1, CDR-L2, CDR-L3 within SEQ ID NO: 1033; 71) the heavy chain variable region comprises the CDR-H1, CDR-H2 CDR-H3 within SEQ ID NO: 960 and the light chain variable region comprises the CDR-L1, CDR-L2, CDR-L3 within SEQ ID NO: 1034; 72) the heavy chain variable region comprises the CDR-H1, CDR-H2 CDR-H3 within SEQ ID NO: 961 and the light chain variable region comprises the CDR-L1, CDR-L2, CDR-L3 within SEQ ID NO: 1035; 73) the heavy chain variable region comprises the CDR-H1, CDR-H2, CDR-H3 within SEQ ID NO: 962 and the light chain variable region comprises the CDR-L1, CDR-L2, CDR-L3 within SEQ ID NO: 1036; or 74) the heavy chain variable region comprises the CDR-H1, CDR-H2, CDR-H3 within SEQ ID NO: 963 and the light chain variable region comprises the CDR-L1, CDR-L2, CDR-L3 within SEQ ID NO: 1037.

In some embodiments of the anti-CD70 binding domains: 1) the heavy chain variable region comprises SEQ ID NO: 890 and the light chain variable region comprises SEQ ID NO: 964; 2) the heavy chain variable region comprises SEQ ID NO: 891 and the light chain variable region comprises SEQ ID NO: 965; 3) the heavy chain variable region comprises SEQ ID NO: 892 and the light chain variable region comprises SEQ ID NO: 966; 4) the heavy chain variable region comprises SEQ ID NO: 893 and the light chain variable region comprises SEQ ID NO: 967; 5) the heavy chain variable region comprises SEQ ID NO: 894 and the light chain variable region comprises SEQ ID NO: 968; 6) the heavy chain variable region comprises SEQ ID NO: 895 and the light chain variable region comprises SEQ ID NO: 969; 7) the heavy chain variable region comprises SEQ ID NO: 896 and the light chain variable region comprises SEQ ID NO: 970; 8) the heavy chain variable region comprises SEQ ID NO: 897 and the light chain variable region comprises SEQ ID NO: 971; 9) the heavy chain variable region comprises SEQ ID NO: 898 and the light chain variable region comprises SEQ ID NO: 972; 10) the heavy chain variable region comprises SEQ ID NO: 899 and the light chain variable region comprises SEQ ID NO: 973; 11) the heavy chain variable region comprises SEQ ID NO: 900 and the light chain variable region comprises SEQ ID NO: 974; 12) the heavy chain variable region comprises SEQ ID NO: 901 and the light chain variable region comprises SEQ ID NO: 975; 13) the heavy chain variable region comprises SEQ ID NO: 902 and the light chain variable region comprises SEQ ID NO: 976; 14) the heavy chain variable region comprises SEQ ID NO: 903 and the light chain variable region comprises SEQ ID NO: 977; 15) the heavy chain variable region comprises SEQ ID NO: 904 and the light chain variable region comprises SEQ ID NO: 978; 16) the heavy chain variable region comprises SEQ ID NO: 905 and the light chain variable region comprises SEQ ID NO: 979; 17) the heavy chain variable region comprises SEQ ID NO: 906 and the light chain variable region comprises SEQ ID NO: 980; 18) the heavy chain variable region comprises SEQ ID NO: 907 and the light chain variable region comprises SEQ ID NO: 981; 19) the heavy chain variable region comprises SEQ ID NO: 908 and the light chain variable region comprises SEQ ID NO: 982; 20) the heavy chain variable region comprises SEQ ID NO: 909 and the light chain variable region comprises SEQ ID NO: 983; 21) the heavy chain variable region comprises SEQ ID NO: 910 and the light chain variable region comprises SEQ ID NO: 984; 22) the heavy chain variable region comprises SEQ ID NO: 911 and the light chain variable region comprises SEQ ID NO: 985; 23) the heavy chain variable region comprises SEQ ID NO: 912 and the light chain variable region comprises SEQ ID NO: 986; 24) the heavy chain variable region comprises SEQ ID NO: 913 and the light chain variable region comprises SEQ ID NO: 987; 25) the heavy chain variable region comprises SEQ ID NO: 914 and the light chain variable region comprises SEQ ID NO: 988; 26) the heavy chain variable region comprises SEQ ID NO: 915 and the light chain variable region comprises SEQ ID NO: 989; 27) the heavy chain variable region comprises SEQ ID NO: 916 and the light chain variable region comprises SEQ ID NO: 990; 28) the heavy chain variable region comprises SEQ ID NO: 917 and the light chain variable region comprises SEQ ID NO: 991; 29) the heavy chain variable region comprises SEQ ID NO: 918 and the light chain variable region comprises SEQ ID NO: 992; 30) the heavy chain variable region comprises SEQ ID NO: 919 and the light chain variable region comprises SEQ ID NO: 993; 31) the heavy chain variable region comprises SEQ ID NO: 920 and the light chain variable region comprises SEQ ID NO: 994; 32) the heavy chain variable region comprises SEQ ID NO: 921 and the light chain variable region comprises SEQ ID NO: 995; 33) the heavy chain variable region comprises SEQ ID NO: 922 and the light chain variable region comprises SEQ ID NO: 996; 34) the heavy chain variable region comprises SEQ ID NO: 923 and the light chain variable region comprises SEQ ID NO: 997; 35) the heavy chain variable region comprises SEQ ID NO: 924 and the light chain variable region comprises SEQ ID NO: 998; 36) the heavy chain variable region comprises SEQ ID NO: 925 and the light chain variable region comprises SEQ ID NO: 999; 37) the heavy chain variable region comprises SEQ ID NO: 926 and the light chain variable region comprises SEQ ID NO: 1000; 38) the heavy chain variable region comprises SEQ ID NO: 927 and the light chain variable region comprises SEQ ID NO: 1001; 39) the heavy chain variable region comprises SEQ ID NO: 928 and the light chain variable region comprises SEQ ID NO: 1002; 40) the heavy chain variable region comprises SEQ ID NO: 929 and the light chain variable region comprises SEQ ID NO: 1003; 41) the heavy chain variable region comprises SEQ ID NO: 930 and the light chain variable region comprises SEQ ID NO: 1004; 42) the heavy chain variable region comprises SEQ ID NO: 931 and the light chain variable region comprises SEQ ID NO: 1005; 43) the heavy chain variable region comprises SEQ ID NO: 932 and the light chain variable region comprises SEQ ID NO: 1006; 44) the heavy chain variable region comprises SEQ ID NO: 933 and the light chain variable region comprises SEQ ID NO: 1007; 45) the heavy chain variable region comprises SEQ ID NO: 934 and the light chain variable region comprises SEQ ID NO: 1008; 46) the heavy chain variable region comprises SEQ ID NO: 935 and the light chain variable region comprises SEQ ID NO: 1009; 47) the heavy chain variable region comprises SEQ ID NO: 936 and the light chain variable region comprises SEQ ID NO: 1010; 48) the heavy chain variable region comprises SEQ ID NO: 937 and the light chain variable region comprises SEQ ID NO: 1011; 49) the heavy chain variable region comprises SEQ ID NO: 938 and the light chain variable region comprises SEQ ID NO: 1012; 50) the heavy chain variable region comprises SEQ ID NO: 939 and the light chain variable region comprises SEQ ID NO: 1013; 51) the heavy chain variable region comprises SEQ ID NO: 940 and the light chain variable region comprises SEQ ID NO: 1014; 52) the heavy chain variable region comprises SEQ ID NO: 941 and the light chain variable region comprises SEQ ID NO: 1015; 53) the heavy chain variable region comprises SEQ ID NO: 942 and the light chain variable region comprises SEQ ID NO: 1016; 54) the heavy chain variable region comprises SEQ ID NO: 943 and the light chain variable region comprises SEQ ID NO: 1017; 55) the heavy chain variable region comprises SEQ ID NO: 944 and the light chain variable region comprises SEQ ID NO: 1018; 56) the heavy chain variable region comprises SEQ ID NO: 945 and the light chain variable region comprises SEQ ID NO: 1019; 57) the heavy chain variable region comprises SEQ ID NO: 946 and the light chain variable region comprises SEQ ID NO: 1020; 58) the heavy chain variable region comprises SEQ ID NO: 947 and the light chain variable region comprises SEQ ID NO: 1021; 59) the heavy chain variable region comprises SEQ ID NO: 948 and the light chain variable region comprises SEQ ID NO: 1022; 60) the heavy chain variable region comprises SEQ ID NO: 949 and the light chain variable region comprises SEQ ID NO: 1023; 61) the heavy chain variable region comprises SEQ ID NO: 950 and the light chain variable region comprises SEQ ID NO: 1024; 62) the heavy chain variable region comprises SEQ ID NO: 951 and the light chain variable region comprises SEQ ID NO: 1025; 63) the heavy chain variable region comprises SEQ ID NO: 952 and the light chain variable region comprises SEQ ID NO: 1026; 64) the heavy chain variable region comprises SEQ ID NO: 953 and the light chain variable region comprises SEQ ID NO: 1027; 65) the heavy chain variable region comprises SEQ ID NO: 954 and the light chain variable region comprises SEQ ID NO: 1028; 66) the heavy chain variable region comprises SEQ ID NO: 955 and the light chain variable region comprises SEQ ID NO: 1029; 67) the heavy chain variable region comprises SEQ ID NO: 956 and the light chain variable region comprises SEQ ID NO: 1030; 68) the heavy chain variable region comprises SEQ ID NO: 957 and the light chain variable region comprises SEQ ID NO: 1031; 69) the heavy chain variable region comprises SEQ ID NO: 958 and the light chain variable region comprises SEQ ID NO: 1032; 70) the heavy chain variable region comprises SEQ ID NO: 959 and the light chain variable region comprises SEQ ID NO: 1033; 71) the heavy chain variable region comprises SEQ ID NO: 960 and the light chain variable region comprises SEQ ID NO: 1034; 72) the heavy chain variable region comprises SEQ ID NO: 961 and the light chain variable region comprises SEQ ID NO: 1035; 73) the heavy chain variable region comprises SEQ ID NO: 962 and the light chain variable region comprises SEQ ID NO: 1036; or 74) the heavy chain variable region comprises SEQ ID NO: 963 and the light chain variable region comprises SEQ ID NO: 1037.

In some embodiments of the anti-CD70 binding domains, the heavy chain variable region and/or light chain variable region comprise a framework. In some embodiments, the heavy chain variable region comprises a FW-H1, FW-H2, FW-H3, and FW-H4. In some embodiments, the heavy chain variable region comprises the order of FW-H1, CDR-H1, FW-H2, CDR-H2, FW-H3, CDR-H3, and FW-H4 from N-terminus to C-terminus. In some embodiments, the light chain variable region comprises a FW-L1, FW-L2, FW-L3, and FW-L4. In some embodiments, the light chain variable region comprises the order of FW-L1, CDR-L1, FW-L2, CDR-L2, FW-L3, CDR-L3, FW-L4 from N-terminus to C-terminus. In some embodiments, the FW-H1 comprises a sequence having at least 95%, 99%, or 100% sequence identity to a sequence selected from SEQ ID NOs: 399-402; the FW-H2 comprises a sequence having at least 95%, 99%, or 100% sequence identity to a sequence selected from SEQ ID NOs: 403-406; the FW-H3 comprises a sequence having at least 95%, 99%, or 100% sequence identity to a sequence selected from SEQ ID NOs: 407-422; the FW-H4 comprises a sequence having at least 95%, 99%, or 100% sequence identity to a sequence selected from SEQ ID NOs: 423-427; the FW-L1 comprises a sequence having at least 95%, 99%, or 100% sequence identity to a sequence selected from SEQ ID NOs: 650-653; the FW-L2 comprises a sequence having at least 95%, 99%, or 100% sequence identity to a sequence selected from SEQ ID NOs: 654-657; the FW-L3 comprises a sequence having at least 95%, 99%, or 100% sequence identity to a sequence selected from SEQ ID NOs: 658-661; the FW-L4 comprises a sequence having at least 95%, 99%, or 100% sequence identity to a sequence selected from SEQ ID NOs: 662-667.

In some embodiments of the anti-CD70 binding domains, the heavy chain variable domain is encoded by a nucleic acid sequence having at least 75%, 80%, 85%, 90%, 95%, 99%, or 100% sequence identity to any sequence selected from SEQ ID NOs: 1038-1111.

In some embodiments of the anti-CD70 binding domains, the light chain variable domain is encoded by a nucleic acid sequence having at least 75%, 80%, 85%, 90%, 95%, 99%, or 100% sequence identity to any sequence selected from SEQ ID NOs: 1112-1185.

In some embodiments, the anti-CD70 binding domain is an antibody, Fab' fragment, $F(ab')_2$ fragment, or scFv.

In several embodiments, the anti-CD70 binding domain is encoded by a polynucleotide sequence comprising a sequence that is at least 70%, 75%, 80%, 85%, 90%, 91%, 92%, 93%, 94%, 95%, 96%, 97%, 98%, 99%, or more, or a range defined by any two of the aforementioned percentages, identical to the sequence of one or more of SEQ ID NOs: 38-120, 221-229, 1038-1111, and/or 1112-1185. In several embodiments, the anti-CD70 binding domain comprises an amino acid sequences that has at least about 85%, about 90%, about 95%, or more, sequence identity to one or more of SEQ ID NOs: 230-312, 890-963, 964-1037.

Also disclosed herein are CARs. In some embodiments, the CARs are anti-CD70 CARs. In some embodiments, the CARs comprise any one or more of the anti-CD70 binding domains disclosed herein.

In some embodiments, the CARs further comprise an OX40 subdomain and a CD3zeta subdomain. In several embodiments, the OX40 subdomain is encoded by a sequence having at least 95% sequence identity to SEQ ID NO: 5. In several embodiments, the OX40 subdomain comprises an amino acid sequence having at least 85%, at least 90%, at least 95%, at least 99%, or at least 100% sequence identity to SEQ ID NO: 6. In several embodiments, the CD3zeta subdomain is encoded by a sequence having at least 95% sequence identity to SEQ ID NO: 7. In several embodiments, the CD3zeta subdomain comprises an amino acid sequence having at least 85%, at least 90%, at least 95%, at least 99%, or at least 100% sequence identity to SEQ ID NO: 8. In several embodiments, the mbIL15 is encoded by a sequence having at least 95% sequence identity to SEQ ID NO: 1188. In several embodiments, the one or more of SEQ ID NOS: 36-120, 221-229, 1038-1111, and/or 1112-1185, the polynucleotide encoding the OX40 subdomain, the polynucleotide encoding the CD3zeta subdomain, and the polynucleotide encoding mbIL15 are arranged in a 5' to 3' orientation within the polynucleotide.

In several embodiments, an anti-CD70 CAR is provided and is encoded by a polynucleotide having at least 70%, 75%, 80%, 85%, 90%, 91%, 92%, 93%, 94%, 95%, 96%, 97%, 98%, 99%, or more, or a range defined by any two of the aforementioned percentages, identical to the sequence of one or more of SEQ ID NOs: 138-220 or a portion thereof (e.g. a portion excluding the mbIL15 sequence and/or self-cleaving peptide sequence). In several embodiments, the CAR comprises an amino acid sequence having at least 70%, 75%, 80%, 85%, 90%, 91%, 92%, 93%, 94%, 95%, 96%, 97%, 98%, 99%, or more, or a range defined by any two of the aforementioned percentages, identical to the sequence of one or more of SEQ ID NOs 313-395, or a portion thereof (e.g. a portion excluding the mbIL15 sequence and/or self-cleaving peptide sequence).

Figure 1:
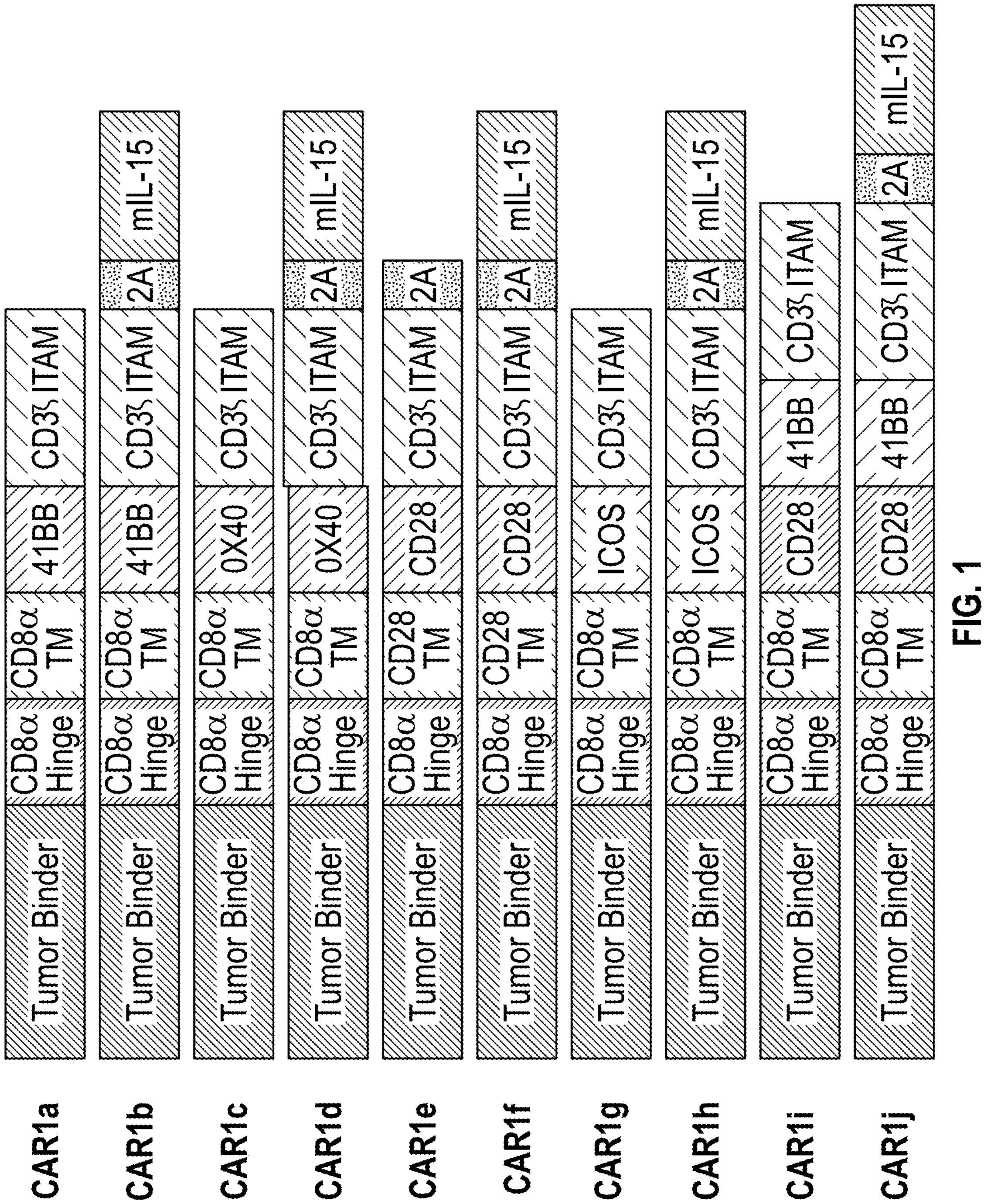
FIG. 1 depicts non-limiting schematics of tumor-directed chimeric antigen receptors.

In several embodiments, there is provided a polynucleotide encoding a Tumor Binder/CD8hinge/CD8hinge-CD8TM/4-1 BB/CD3zeta chimeric antigen receptor complex (see FIG. 1, CAR1a). The polynucleotide comprises or is composed of a Tumor Binder, a CD8a hinge, a CD8a transmembrane domain, a 4-1BB domain, and a CD3zeta domain, as described herein. In several embodiments, this receptor complex is encoded by a nucleic acid molecule comprising a sequence obtained from a combination of sequences disclosed herein, or comprises an amino acid sequence obtained from a combination of sequences disclosed herein. In several embodiments, the encoding nucleic acid sequence, or the amino acid sequence, comprises a sequence in accordance with one or more SEQ ID NOS as described herein, such as those included herein as examples of constituent parts. In several embodiments, the encoding nucleic acid sequence, or the amino acid sequence, comprises a sequence that shares at least about 90%, at least about 94%, at least about 95%, at least about 96%, at least about 97%, at least about 98%, or at least about 99%, sequence identity, homology and/or functional equivalence with a sequence resulting from the combination one or more SEQ ID NOS as described herein. It shall be appreciated that certain sequence variability, extensions, and/or truncations of the disclosed sequences may result when combining sequences, as a result of, for example, ease or efficiency in cloning (e.g., for creation of a restriction site).

In several embodiments, there is provided a polynucleotide encoding a Tumor Binder/CD8hinge/CD8hinge-CD8TM/4-1BB/CD3zeta/2A/mIL-15 chimeric antigen receptor complex (see FIG. 1, CAR1b). The polynucleotide comprises or is composed of a Tumor Binder, a CD8a hinge, a CD8a transmembrane domain, a 4-1BB domain, a CD3zeta domain, a 2A cleavage site, and an mIL-15 domain as described herein. In several embodiments, this receptor complex is encoded by a nucleic acid molecule comprising a sequence obtained from a combination of sequences disclosed herein, or comprises an amino acid sequence obtained from a combination of sequences disclosed herein. In several embodiments, the encoding nucleic acid sequence, or the amino acid sequence, comprises a sequence in accordance with one or more SEQ ID NOS as described herein, such as those included herein as examples of constituent parts. In several embodiments, the encoding nucleic acid sequence, or the amino acid sequence, comprises a sequence that shares at least about 90%, at least about 94%, at least about 95%, at least about 96%, at least about 97%, at least about 98%, or at least about 99%, sequence identity, homology and/or functional equivalence with a sequence resulting from the combination one or more SEQ ID NOS as described herein. It shall be appreciated that certain sequence variability, extensions, and/or truncations of the disclosed sequences may result when combining sequences, as a result of, for example, ease or efficiency in cloning (e.g., for creation of a restriction site).

In one embodiment, there is provided a polynucleotide encoding a Tumor Binder/CD8hinge-CD8TM/$OX_{40}$/CD3zeta chimeric antigen receptor complex (see FIG. 1, CAR1c). The polynucleotide comprises or is composed of tumor binder, a CD8a hinge, a CD8a transmembrane domain, an $OX_{40}$ domain, and a CD3zeta domain as described herein. In several embodiments, this receptor complex is encoded by a nucleic acid molecule comprising a sequence obtained from a combination of sequences disclosed herein, or comprises an amino acid sequence obtained from a combination of sequences disclosed herein. In several embodiments, the encoding nucleic acid sequence, or the amino acid sequence, comprises a sequence in accordance with one or more SEQ ID NOS as described herein, such as those included herein as examples of constituent parts. In several embodiments, the encoding nucleic acid sequence, or the amino acid sequence, comprises a sequence that shares at least about 90%, at least about 94%, at least about 95%, at least about 96%, at least about 97%, at least about 98%, or at least about 99%, sequence identity, homology and/or functional equivalence with a sequence resulting from the combination one or more SEQ ID NOS as described herein. It shall be appreciated that certain sequence variability, extensions, and/or truncations of the disclosed sequences may result when combining sequences, as a result of, for example, ease or efficiency in cloning (e.g., for creation of a restriction site).

In several embodiments, there is provided a polynucleotide encoding a tumor binder/CD8hinge-CD8TM/$OX_{40}$/CD3zeta/2A/mIL-15 chimeric antigen receptor complex (see FIG. 1, CAR1d). The polynucleotide comprises or is composed of a Tumor Binder, a CD8a hinge, a CD8a transmembrane domain, an $OX_{40}$ domain, a CD3zeta domain, a 2A cleavage site, and an mIL-15 domain as described herein. In several embodiments, this receptor complex is encoded by a nucleic acid molecule comprising a sequence obtained from a combination of sequences disclosed herein, or comprises an amino acid sequence obtained from a combination of sequences disclosed herein. In several embodiments, the encoding nucleic acid sequence, or the amino acid sequence, comprises a sequence in accordance with one or more SEQ ID NOS as described herein, such as those included herein as examples of constituent parts. In several embodiments, the encoding nucleic acid sequence, or the amino acid sequence, comprises a sequence that shares at least about 90%, at least about 94%, at least about 95%, at least about 96%, at least about 97%, at least about 98%, or at least about 99%, sequence identity, homology and/or functional equivalence with a sequence resulting from the combination one or more SEQ ID NOS as described herein. It shall be appreciated that certain sequence variability, extensions, and/or truncations of the disclosed sequences may result when combining sequences, as a result of, for example, ease or efficiency in cloning (e.g., for creation of a restriction site). In several embodiments, the anti-CD70 binding domain comprises a polynucleotide sequence that is at least 70%, 75%, 80%, 85%, 90%, 91%, 92%, 93%, 94%, 95%, 96%, 97%, 98%, 99%, or more, or a range defined by any two of the aforementioned percentages, identical to the sequence of either SEQ ID NO: 36 and/or SEQ ID NO: 37. In several embodiments, the anti-CD70 binding domain comprises a polynucleotide sequence that is at least 70%, 75%, 80%, 85%, 90%, 91%, 92%, 93%, 94%, 95%, 96%, 97%, 98%, 99%, or more, or a range defined by any two of the aforementioned percentages, identical to the sequence of either SEQ ID NOs: 38-120, 221-229, 1038-1111, and/or 1112-1185. In several embodiments, an anti-CD70 CAR is provided and is encoded by a polynucleotide having at least 70%, 75%, 80%, 85%, 90%, 91%, 92%, 93%, 94%, 95%, 96%, 97%, 98%, 99%, or more, or a range defined by any two of the aforementioned percentages, identical to the sequence of one or more of SEQ ID NOs: 138-220, or a portion thereof (e.g. a portion excluding the mbIL15 sequence and/or self-cleaving peptide sequence). In several embodiments, the CAR comprises an amino acid sequences having at least 70%, 75%, 80%, 85%, 90%, 91%, 92%, 93%, 94%, 95%, 96%, 97%, 98%, 99%, or more, or a range defined by any two of the aforementioned percentages, identical to the sequence of one or more of SEQ ID NOs 313-395, or a portion thereof (e.g. a portion excluding the mbIL15 sequence and/or self-cleaving peptide sequence).

In several embodiments, there is provided a polynucleotide encoding a Tumor Binder/CD8hinge-CD28TM/CD28/CD3zeta chimeric antigen receptor complex (see FIG. 1, CAR1e). The polynucleotide comprises or is composed of a Tumor Binder, a CD8a hinge, a CD28 transmembrane domain, a CD28 domain, and a CD3zeta domain as described herein. In several embodiments, this receptor complex is encoded by a nucleic acid molecule comprising a sequence obtained from a combination of sequences disclosed herein, or comprises an amino acid sequence obtained from a combination of sequences disclosed herein. In several embodiments, the encoding nucleic acid sequence, or the amino acid sequence, comprises a sequence in accordance with one or more SEQ ID NOS as described herein, such as those included herein as examples of constituent parts. In several embodiments, the encoding nucleic acid sequence, or the amino acid sequence, comprises a sequence that shares at least about 90%, at least about 94%, at least about 95%, at least about 96%, at least about 97%, at least about 98%, or at least about 99%, sequence identity, homology and/or functional equivalence with a sequence resulting from the combination one or more SEQ ID NOS as described herein. It shall be appreciated that certain sequence variability, extensions, and/or truncations of the disclosed sequences may result when combining sequences, as a result of, for example, ease or efficiency in cloning (e.g., for creation of a restriction site).

In several embodiments, there is provided a polynucleotide encoding a Tumor Binder/CD8hinge-CD28TM/CD28/CD3zeta/2A/mIL-15 chimeric antigen receptor complex (see FIG. 1, CAR1f). The polynucleotide comprises or is composed of a Tumor Binder, a CD8a hinge, a CD28 transmembrane domain, a CD28 domain, a CD3zeta domain, a 2A cleavage site, and an mIL-15 domain as described herein. In several embodiments, this receptor complex is encoded by a nucleic acid molecule comprising a sequence obtained from a combination of sequences disclosed herein, or comprises an amino acid sequence obtained from a combination of sequences disclosed herein. In several embodiments, the encoding nucleic acid sequence, or the amino acid sequence, comprises a sequence in accordance with one or more SEQ ID NOS as described herein, such as those included herein as examples of constituent parts. In several embodiments, the encoding nucleic acid sequence, or the amino acid sequence, comprises a sequence that shares at least about 90%, at least about 94%, at least about 95%, at least about 96%, at least about 97%, at least about 98%, or at least about 99%, sequence identity, homology and/or functional equivalence with a sequence resulting from the combination one or more SEQ ID NOS as described herein. It shall be appreciated that certain sequence variability, extensions, and/or truncations of the disclosed sequences may result when combining sequences, as a result of, for example, ease or efficiency in cloning (e.g., for creation of a restriction site).

In several embodiments, there is provided a polynucleotide encoding a Tumor Binder/CD8hinge/CD8aTM/ICOS/CD3zeta chimeric antigen receptor complex (see FIG. 1, CAR1g). The polynucleotide comprises or is composed of a Tumor Binder, a CD8a hinge, a CD8a transmembrane domain, inducible costimulator (ICOS) signaling domain, and a CD3zeta domain. In several embodiments, the polynucleotide further encodes mbIL15 (see FIG. 1, CAR1 h). In several embodiments, this receptor complex is encoded by a nucleic acid molecule comprising a sequence obtained from a combination of sequences disclosed herein, or comprises an amino acid sequence obtained from a combination of sequences disclosed herein. In several embodiments, the encoding nucleic acid sequence, or the amino acid sequence, comprises a sequence in accordance with one or more SEQ ID NOS as described herein, such as those included herein as examples of constituent parts. In several embodiments, the encoding nucleic acid sequence, or the amino acid sequence, comprises a sequence that shares at least about 90%, at least about 94%, at least about 95%, at least about 96%, at least about 97%, at least about 98%, or at least about 99%, sequence identity, homology and/or functional equivalence with a sequence resulting from the combination one or more SEQ ID NOS as described herein. It shall be appreciated that certain sequence variability, extensions, and/or truncations of the disclosed sequences may result when combining sequences, as a result of, for example, ease or efficiency in cloning (e.g., for creation of a restriction site).

In several embodiments, there is provided a polynucleotide encoding a Tumor Binder/CD8hinge/CD8aTM/CD28/4-1 BB/CD3zeta chimeric antigen receptor complex (see FIG. 1, CAR1 i). The polynucleotide comprises or is composed of a Tumor Binder, a CD8a hinge, a CD8a transmembrane domain, a CD28 signaling domain, a 4-1BB signaling domain, and a CD3zeta domain. In several embodiments, the polynucleotide further encodes mbIL15 (see FIG. 1, CAR1j). In several embodiments, this receptor complex is encoded by a nucleic acid molecule comprising a sequence obtained from a combination of sequences disclosed herein, or comprises an amino acid sequence obtained from a combination of sequences disclosed herein. In several embodiments, the encoding nucleic acid sequence, or the amino acid sequence, comprises a sequence in accordance with one or more SEQ ID NOS as described herein, such as those included herein as examples of constituent parts. In several embodiments, the encoding nucleic acid sequence, or the amino acid sequence, comprises a sequence that shares at least about 90%, at least about 94%, at least about 95%, at least about 96%, at least about 97%, at least about 98%, or at least about 99%, sequence identity, homology and/or functional equivalence with a sequence resulting from the combination one or more SEQ ID NOS as described herein. It shall be appreciated that certain sequence variability, extensions, and/or truncations of the disclosed sequences may result when combining sequences, as a result of, for example, ease or efficiency in cloning (e.g., for creation of a restriction site).

Figure 2:
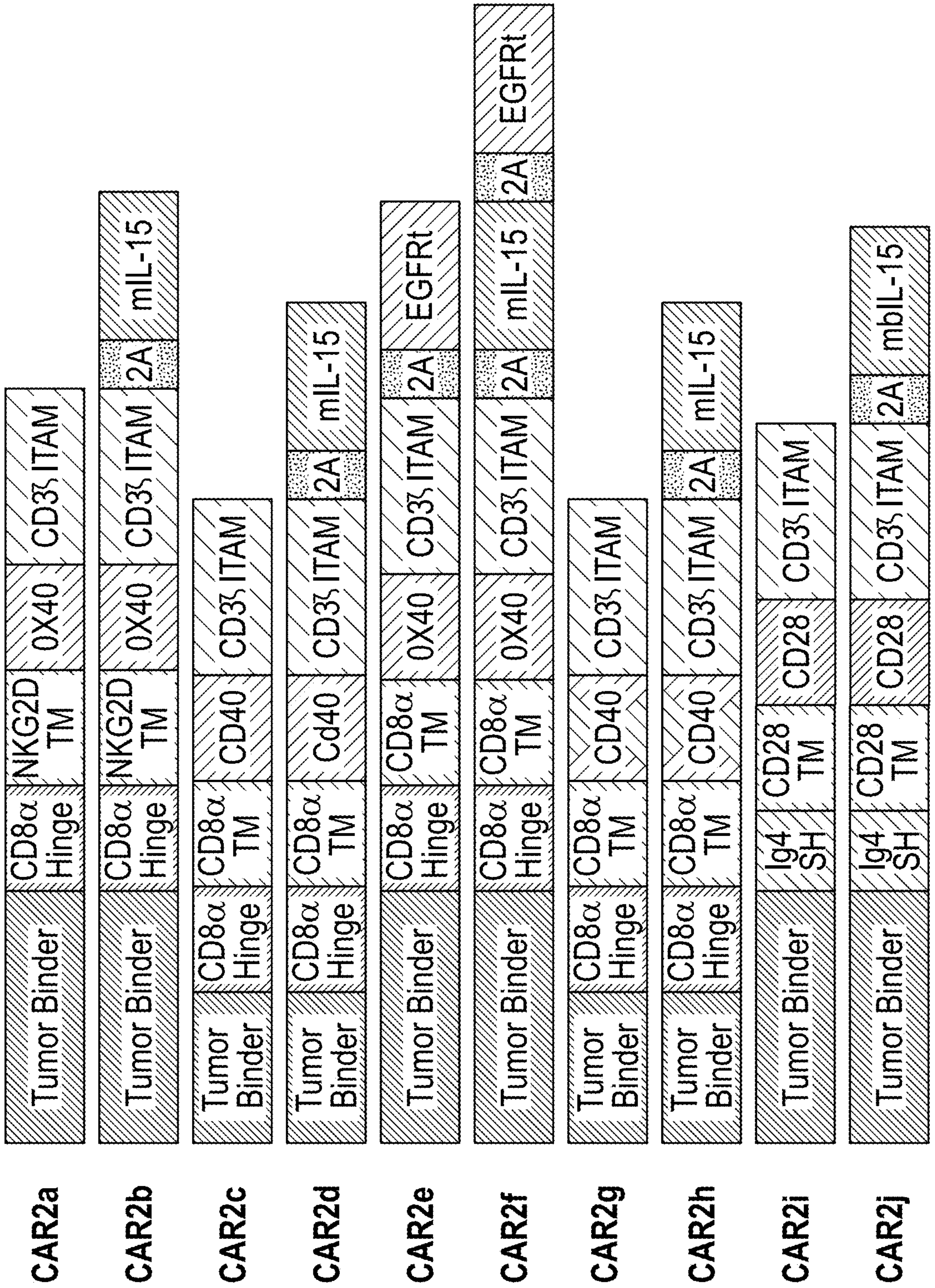
FIG. 2 depicts additional non-limiting schematics of tumor-directed chimeric antigen receptors.

In several embodiments, there is provided a polynucleotide encoding a Tumor Binder/CD8hinge/NKG2DTM/$OX_{40}$/CD3zeta chimeric antigen receptor complex (see FIG. 2, CAR2a). The polynucleotide comprises or is composed of a Tumor Binder (such as a light chain variable region of an scFv), a CD8a hinge, an NKG2D transmembrane domain, an $OX_{40}$ signaling domain, and a CD3zeta domain. In several embodiments, the polynucleotide further encodes mbIL15 (see FIG. 2, CAR2b). In several embodiments, this receptor complex is encoded by a nucleic acid molecule comprising a sequence obtained from a combination of sequences disclosed herein, or comprises an amino acid sequence obtained from a combination of sequences disclosed herein. In several embodiments, the encoding nucleic acid sequence, or the amino acid sequence, comprises a sequence in accordance with one or more SEQ ID NOS as described herein, such as those included herein as examples of constituent parts. In several embodiments, the encoding nucleic acid sequence, or the amino acid sequence, comprises a sequence that shares at least about 90%, at least about 94%, at least about 95%, at least about 96%, at least about 97%, at least about 98%, or at least about 99%, sequence identity, homology and/or functional equivalence with a sequence resulting from the combination one or more SEQ ID NOS as described herein. It shall be appreciated that certain sequence variability, extensions, and/or truncations of the disclosed sequences may result when combining sequences, as a result of, for example, ease or efficiency in cloning (e.g., for creation of a restriction site).

In several embodiments, there is provided a polynucleotide encoding a Tumor Binder/CD8hinge/CD8aTM/$OX_{40}$/CD3zeta/2A/EGFRt chimeric antigen receptor complex (see FIG. 2, CAR2e). The polynucleotide comprises or is composed of a Tumor Binder, a CD8a hinge, a CD8a transmembrane domain, an $OX_{40}$ signaling domain, a CD3zeta domain, a 2A cleavage side, and a truncated version of the epidermal growth factor receptor (EGFRt). In several embodiments, the chimeric antigen receptor further comprises mbIL15 (see FIG. 2, CAR2f). In several embodiments, this receptor complex is encoded by a nucleic acid molecule comprising a sequence obtained from a combination of sequences disclosed herein, or comprises an amino acid sequence obtained from a combination of sequences disclosed herein. In several embodiments, the encoding nucleic acid sequence, or the amino acid sequence, comprises a sequence in accordance with one or more SEQ ID NOS as described herein, such as those included herein as examples of constituent parts. In several embodiments, the encoding nucleic acid sequence, or the amino acid sequence, comprises a sequence that shares at least about 90%, at least about 94%, at least about 95%, at least about 96%, at least about 97%, at least about 98%, or at least about 99%, sequence identity, homology and/or functional equivalence with a sequence resulting from the combination one or more SEQ ID NOS as described herein. It shall be appreciated that certain sequence variability, extensions, and/or truncations of the disclosed sequences may result when combining sequences, as a result of, for example, ease or efficiency in cloning (e.g., for creation of a restriction site).

In several embodiments, there is provided a polynucleotide encoding a Tumor Binder/CD8hinge/NKG2DTM/$OX_{40}$/CD3zeta chimeric antigen receptor complex (see FIG. 2, CAR2g). The polynucleotide comprises or is composed of a Tumor Binder (such as a heavy chain variable region of an scFv), a CD8a hinge, an NKG2D transmembrane domain, an $OX_{40}$ signaling domain, and a CD3zeta domain. In several embodiments, the polynucleotide further encodes mbIL15 (see FIG. 2, CAR2h). In several embodiments, this receptor complex is encoded by a nucleic acid molecule comprising a sequence obtained from a combination of sequences disclosed herein, or comprises an amino acid sequence obtained from a combination of sequences disclosed herein. In several embodiments, the encoding nucleic acid sequence, or the amino acid sequence, comprises a sequence in accordance with one or more SEQ ID NOS as described herein, such as those included herein as examples of constituent parts. In several embodiments, the encoding nucleic acid sequence, or the amino acid sequence, comprises a sequence that shares at least about 90%, at least about 94%, at least about 95%, at least about 96%, at least about 97%, at least about 98%, or at least about 99%, sequence identity, homology and/or functional equivalence with a sequence resulting from the combination one or more SEQ ID NOS as described herein. It shall be appreciated that certain sequence variability, extensions, and/or truncations of the disclosed sequences may result when combining sequences, as a result of, for example, ease or efficiency in cloning (e.g., for creation of a restriction site).

In several embodiments, there is provided a polynucleotide encoding a Tumor Binder/Ig4SH-CD28TM/CD28/CD3zeta chimeric antigen receptor complex (see FIG. 2, CAR2i). The polynucleotide comprises or is composed of a Tumor Binder, an Ig4 SH domain, a CD28 transmembrane domain, a CD28 domain, and a CD3zeta domain as described herein. In several embodiments, the polynucleotide further encodes mbIL15 (see FIG. 2, CAR2j). In several embodiments, this receptor complex is encoded by a nucleic acid molecule comprising a sequence obtained from a combination of sequences disclosed herein, or comprises an amino acid sequence obtained from a combination of sequences disclosed herein. In several embodiments, the encoding nucleic acid sequence, or the amino acid sequence, comprises a sequence in accordance with one or more SEQ ID NOS as described herein, such as those included herein as examples of constituent parts. In several embodiments, the encoding nucleic acid sequence, or the amino acid sequence, comprises a sequence that shares at least about 90%, at least about 94%, at least about 95%, at least about 96%, at least about 97%, at least about 98%, or at least about 99%, sequence identity, homology and/or functional equivalence with a sequence resulting from the combination one or more SEQ ID NOS as described herein. It shall be appreciated that certain sequence variability, extensions, and/or truncations of the disclosed sequences may result when combining sequences, as a result of, for example, ease or efficiency in cloning (e.g., for creation of a restriction site).

Figure 3:
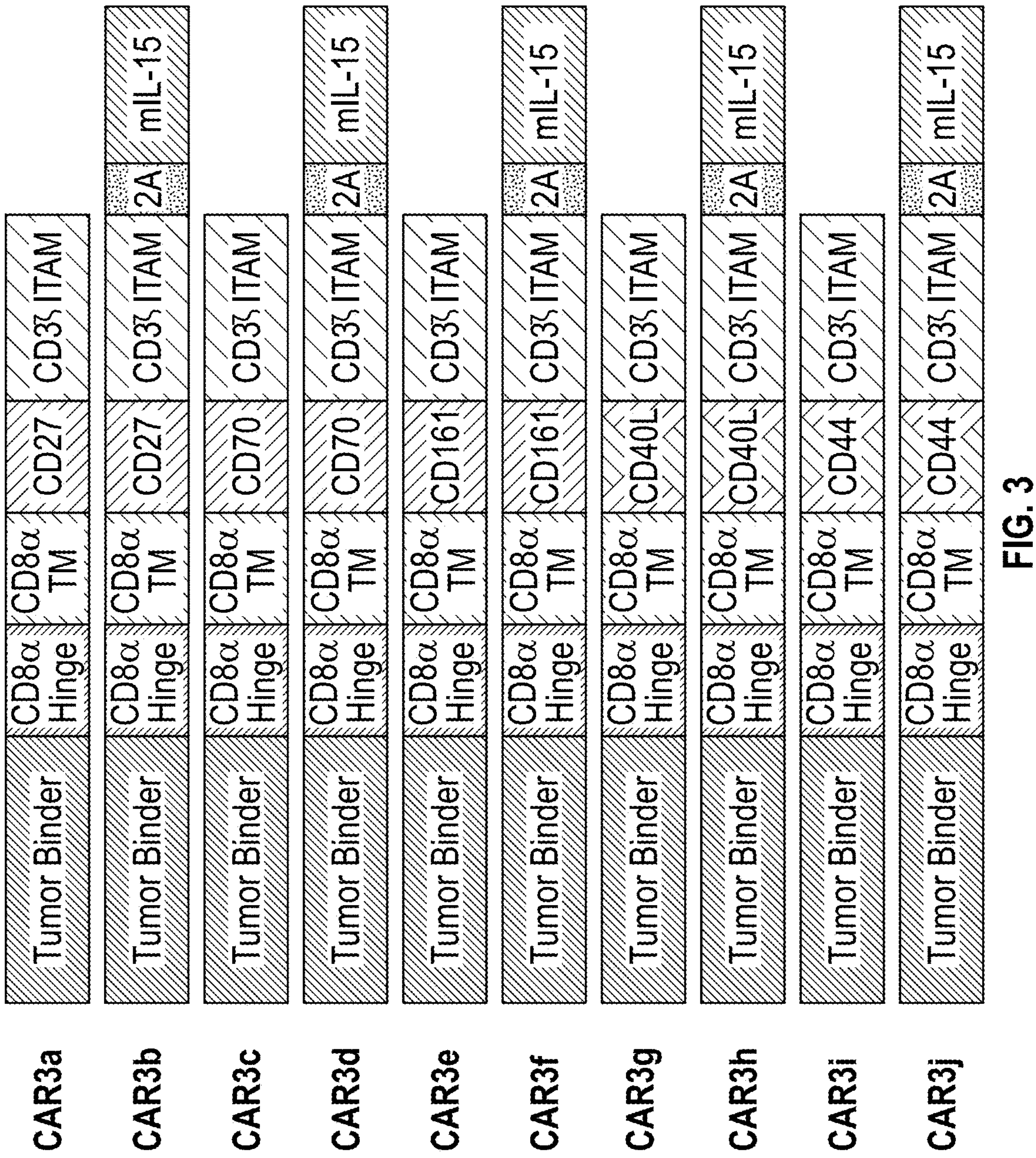
FIG. 3 depicts additional non-limiting schematics of tumor-directed chimeric antigen receptors.

In several embodiments, there is provided a polynucleotide encoding a Tumor Binder/CD8hinge/CD8aTM/CD27/CD3zeta chimeric antigen receptor complex (see FIG. 3, CAR3a). The polynucleotide comprises or is composed of a Tumor Binder, a CD8a hinge, a CD8a transmembrane domain, a CD27 signaling domain, and a CD3zeta domain. In several embodiments, the polynucleotide further encodes mbIL15 (see FIG. 3, CAR3b). In several embodiments, this receptor complex is encoded by a nucleic acid molecule comprising a sequence obtained from a combination of sequences disclosed herein, or comprises an amino acid sequence obtained from a combination of sequences disclosed herein. In several embodiments, the encoding nucleic acid sequence, or the amino acid sequence, comprises a sequence in accordance with one or more SEQ ID NOS as described herein, such as those included herein as examples of constituent parts. In several embodiments, the encoding nucleic acid sequence, or the amino acid sequence, comprises a sequence that shares at least about 90%, at least about 94%, at least about 95%, at least about 96%, at least about 97%, at least about 98%, or at least about 99%, sequence identity, homology and/or functional equivalence with a sequence resulting from the combination one or more SEQ ID NOS as described herein. It shall be appreciated that certain sequence variability, extensions, and/or truncations of the disclosed sequences may result when combining sequences, as a result of, for example, ease or efficiency in cloning (e.g., for creation of a restriction site).

In several embodiments, there is provided a polynucleotide encoding a Tumor Binder/CD8hinge/CD8aTM/CD70/CD3zeta chimeric antigen receptor complex (see FIG. 3, CAR3c). The polynucleotide comprises or is composed of a Tumor Binder, a CD8a hinge, a CD8a transmembrane domain, a CD70 signaling domain, and a CD3zeta domain. In several embodiments, the polynucleotide further encodes mbIL15 (see FIG. 3, CAR3d). In several embodiments, this receptor complex is encoded by a nucleic acid molecule comprising a sequence obtained from a combination of sequences disclosed herein, or comprises an amino acid sequence obtained from a combination of sequences disclosed herein. In several embodiments, the encoding nucleic acid sequence, or the amino acid sequence, comprises a sequence in accordance with one or more SEQ ID NOS as described herein, such as those included herein as examples of constituent parts. In several embodiments, the encoding nucleic acid sequence, or the amino acid sequence, comprises a sequence that shares at least about 90%, at least about 94%, at least about 95%, at least about 96%, at least about 97%, at least about 98%, or at least about 99%, sequence identity, homology and/or functional equivalence with a sequence resulting from the combination one or more SEQ ID NOS as described herein. It shall be appreciated that certain sequence variability, extensions, and/or truncations of the disclosed sequences may result when combining sequences, as a result of, for example, ease or efficiency in cloning (e.g., for creation of a restriction site).

In several embodiments, there is provided a polynucleotide encoding a Tumor Binder/CD8hinge/CD8aTM/CD161/CD3zeta chimeric antigen receptor complex (see FIG. 3, CAR3e). The polynucleotide comprises or is composed of a Tumor Binder, a CD8a hinge, a CD8a transmembrane domain, a CD161 signaling domain, and a CD3zeta domain. In several embodiments, the polynucleotide further encodes mbIL15 (see FIG. 3, CAR3f). In several embodiments, this receptor complex is encoded by a nucleic acid molecule comprising a sequence obtained from a combination of sequences disclosed herein, or comprises an amino acid sequence obtained from a combination of sequences disclosed herein. In several embodiments, the encoding nucleic acid sequence, or the amino acid sequence, comprises a sequence in accordance with one or more SEQ ID NOS as described herein, such as those included herein as examples of constituent parts. In several embodiments, the encoding nucleic acid sequence, or the amino acid sequence, comprises a sequence that shares at least about 90%, at least about 94%, at least about 95%, at least about 96%, at least about 97%, at least about 98%, or at least about 99%, sequence identity, homology and/or functional equivalence with a sequence resulting from the combination one or more SEQ ID NOS as described herein. It shall be appreciated that certain sequence variability, extensions, and/or truncations of the disclosed sequences may result when combining sequences, as a result of, for example, ease or efficiency in cloning (e.g., for creation of a restriction site).

In several embodiments, there is provided a polynucleotide encoding a Tumor Binder/CD8hinge/CD8aTM/CD40L/CD3zeta chimeric antigen receptor complex (see FIG. 3, CAR3g). The polynucleotide comprises or is composed of a Tumor Binder, a CD8a hinge, a CD8a transmembrane domain, a CD40L signaling domain, and a CD3zeta domain. In several embodiments, the polynucleotide further encodes mbIL15 (see FIG. 3, CAR3h). In several embodiments, this receptor complex is encoded by a nucleic acid molecule comprising a sequence obtained from a combination of sequences disclosed herein, or comprises an amino acid sequence obtained from a combination of sequences disclosed herein. In several embodiments, the encoding nucleic acid sequence, or the amino acid sequence, comprises a sequence in accordance with one or more SEQ ID NOS as described herein, such as those included herein as examples of constituent parts. In several embodiments, the encoding nucleic acid sequence, or the amino acid sequence, comprises a sequence that shares at least about 90%, at least about 94%, at least about 95%, at least about 96%, at least about 97%, at least about 98%, or at least about 99%, sequence identity, homology and/or functional equivalence with a sequence resulting from the combination one or more SEQ ID NOS as described herein. It shall be appreciated that certain sequence variability, extensions, and/or truncations of the disclosed sequences may result when combining sequences, as a result of, for example, ease or efficiency in cloning (e.g., for creation of a restriction site).

In several embodiments, there is provided a polynucleotide encoding a Tumor Binder/CD8hinge/CD8aTM/CD44/CD3zeta chimeric antigen receptor complex (see FIG. 3, CAR3i). The polynucleotide comprises or is composed of a Tumor Binder, a CD8a hinge, a CD8a transmembrane domain, a CD44 signaling domain, and a CD3zeta domain. In several embodiments, the polynucleotide further encodes mbIL15 (see FIG. 3, CAR3j). In several embodiments, this receptor complex is encoded by a nucleic acid molecule comprising a sequence obtained from a combination of sequences disclosed herein, or comprises an amino acid sequence obtained from a combination of sequences disclosed herein. In several embodiments, the encoding nucleic acid sequence, or the amino acid sequence, comprises a sequence in accordance with one or more SEQ ID NOS as described herein, such as those included herein as examples of constituent parts. In several embodiments, the encoding nucleic acid sequence, or the amino acid sequence, comprises a sequence that shares at least about 90%, at least about 94%, at least about 95%, at least about 96%, at least about 97%, at least about 98%, or at least about 99%, sequence identity, homology and/or functional equivalence with a sequence resulting from the combination one or more SEQ ID NOS as described herein. It shall be appreciated that certain sequence variability, extensions, and/or truncations of the disclosed sequences may result when combining sequences, as a result of, for example, ease or efficiency in cloning (e.g., for creation of a restriction site).

Figure 4:
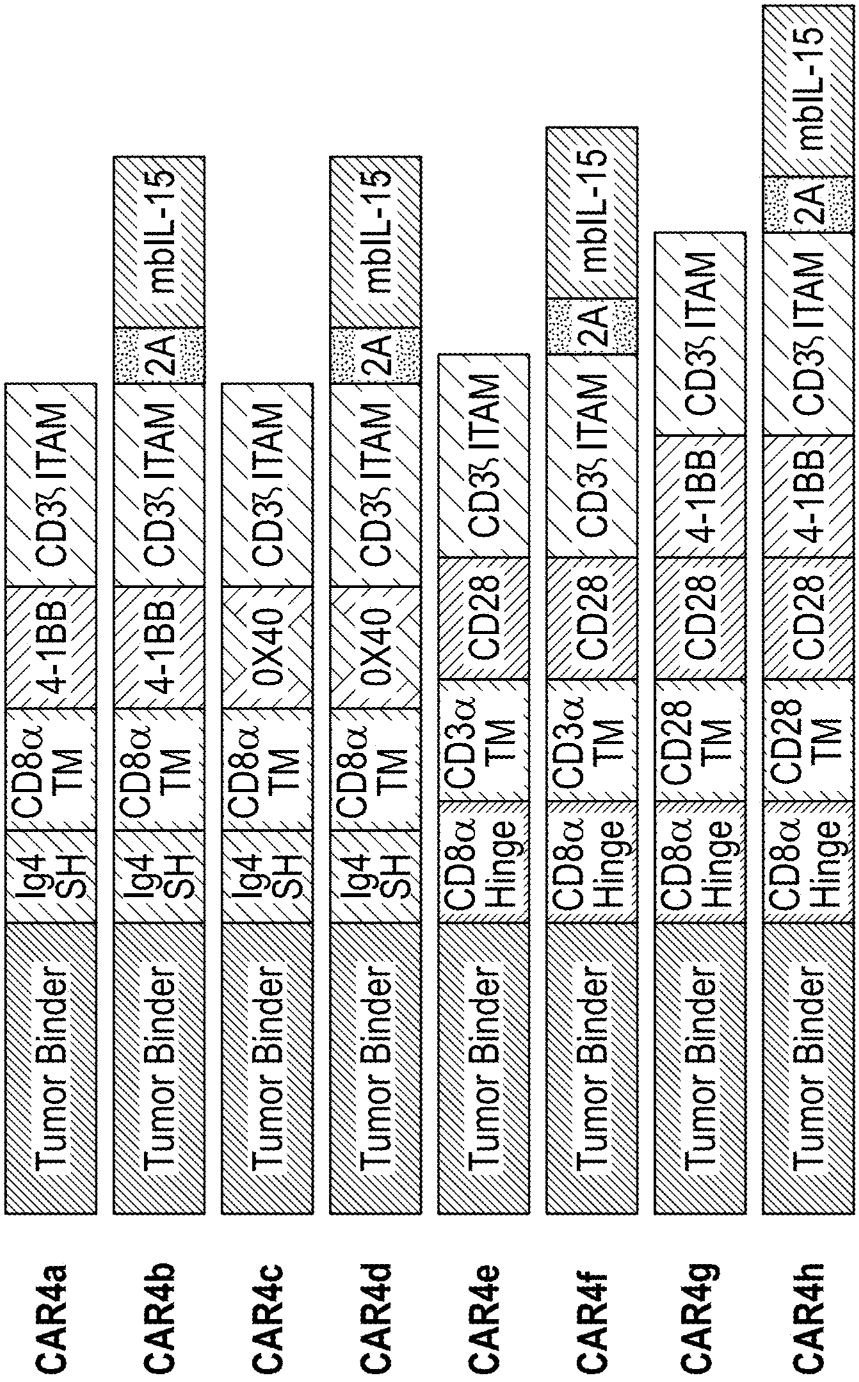
FIG. 4 depicts additional non-limiting schematics of tumor-directed chimeric antigen receptors.

In several embodiments, there is provided a polynucleotide encoding a Tumor Binder/Ig4SH-CD8TM/4-1 BB/CD3zeta chimeric antigen receptor complex (see FIG. 4, CAR4a). The polynucleotide comprises or is composed of a Tumor Binder, an Ig4 SH domain, a CD8a transmembrane domain, a 4-1 BB domain, and a CD3zeta domain as described herein. In several embodiments, the polynucleotide further encodes mbIL15 (see FIG. 4, CAR4b). In several embodiments, this receptor complex is encoded by a nucleic acid molecule comprising a sequence obtained from a combination of sequences disclosed herein, or comprises an amino acid sequence obtained from a combination of sequences disclosed herein. In several embodiments, the encoding nucleic acid sequence, or the amino acid sequence, comprises a sequence in accordance with one or more SEQ ID NOS as described herein, such as those included herein as examples of constituent parts. In several embodiments, the encoding nucleic acid sequence, or the amino acid sequence, comprises a sequence that shares at least about 90%, at least about 94%, at least about 95%, at least about 96%, at least about 97%, at least about 98%, or at least about 99%, sequence identity, homology and/or functional equivalence with a sequence resulting from the combination one or more SEQ ID NOS as described herein. It shall be appreciated that certain sequence variability, extensions, and/or truncations of the disclosed sequences may result when combining sequences, as a result of, for example, ease or efficiency in cloning (e.g., for creation of a restriction site).

In several embodiments, there is provided a polynucleotide encoding a Tumor Binder/Ig4SH-CD8TM/OX40/

CD3zeta chimeric antigen receptor complex (see FIG. 4, CAR4c). The polynucleotide comprises or is composed of a Tumor Binder, a Ig4 SH domain, a CD8a transmembrane domain, an OX40 domain, and a CD3zeta domain as described herein. In several embodiments, the polynucleotide further encodes mbIL15 (see FIG. 4, CAR4d). In several embodiments, this receptor complex is encoded by a nucleic acid molecule comprising a sequence obtained from a combination of sequences disclosed herein, or comprises an amino acid sequence obtained from a combination of sequences disclosed herein. In several embodiments, the encoding nucleic acid sequence, or the amino acid sequence, comprises a sequence in accordance with one or more SEQ ID NOS as described herein, such as those included herein as examples of constituent parts. In several embodiments, the encoding nucleic acid sequence, or the amino acid sequence, comprises a sequence that shares at least about 90%, at least about 94%, at least about 95%, at least about 96%, at least about 97%, at least about 98%, or at least about 99%, sequence identity, homology and/or functional equivalence with a sequence resulting from the combination one or more SEQ ID NOS as described herein. It shall be appreciated that certain sequence variability, extensions, and/or truncations of the disclosed sequences may result when combining sequences, as a result of, for example, ease or efficiency in cloning (e.g., for creation of a restriction site).

In several embodiments, there is provided a polynucleotide encoding a Tumor Binder/CD8hinge-CD3aTM/CD28/CD3zeta chimeric antigen receptor complex (see FIG. 4, CAR4e). The polynucleotide comprises or is composed of a Tumor Binder, a CD8a hinge, a CD3a transmembrane domain, a CD28 domain, and a CD3zeta domain as described herein. In several embodiments, the polynucleotide further encodes mbIL15 (see FIG. 4, CAR4f). In several embodiments, this receptor complex is encoded by a nucleic acid molecule comprising a sequence obtained from a combination of sequences disclosed herein, or comprises an amino acid sequence obtained from a combination of sequences disclosed herein. In several embodiments, the encoding nucleic acid sequence, or the amino acid sequence, comprises a sequence in accordance with one or more SEQ ID NOS as described herein, such as those included herein as examples of constituent parts. In several embodiments, the encoding nucleic acid sequence, or the amino acid sequence, comprises a sequence that shares at least about 90%, at least about 94%, at least about 95%, at least about 96%, at least about 97%, at least about 98%, or at least about 99%, sequence identity, homology and/or functional equivalence with a sequence resulting from the combination one or more SEQ ID NOS as described herein. It shall be appreciated that certain sequence variability, extensions, and/or truncations of the disclosed sequences may result when combining sequences, as a result of, for example, ease or efficiency in cloning (e.g., for creation of a restriction site).

In several embodiments, there is provided a polynucleotide encoding a Tumor Binder/CD8hinge-CD28TM/CD28/4-1 BB/CD3zeta chimeric antigen receptor complex (see FIG. 4, CAR 4g). The polynucleotide comprises or is composed of a Tumor Binder, a CD8a hinge, a CD28 transmembrane domain, a CD28 domain, a 4-1 BB domain, and a CD3zeta domain as described herein. In several embodiments, the polynucleotide further encodes mbIL15 (see FIG. 4, CAR4h). In several embodiments, this receptor complex is encoded by a nucleic acid molecule comprising a sequence obtained from a combination of sequences disclosed herein, or comprises an amino acid sequence obtained from a combination of sequences disclosed herein. In several embodiments, the encoding nucleic acid sequence, or the amino acid sequence, comprises a sequence in accordance with one or more SEQ ID NOS as described herein, such as those included herein as examples of constituent parts. In several embodiments, the encoding nucleic acid sequence, or the amino acid sequence, comprises a sequence that shares at least about 90%, at least about 94%, at least about 95%, at least about 96%, at least about 97%, at least about 98%, or at least about 99%, sequence identity, homology and/or functional equivalence with a sequence resulting from the combination one or more SEQ ID NOS as described herein. It shall be appreciated that certain sequence variability, extensions, and/or truncations of the disclosed sequences may result when combining sequences, as a result of, for example, ease or efficiency in cloning (e.g., for creation of a restriction site).

Figure 5:
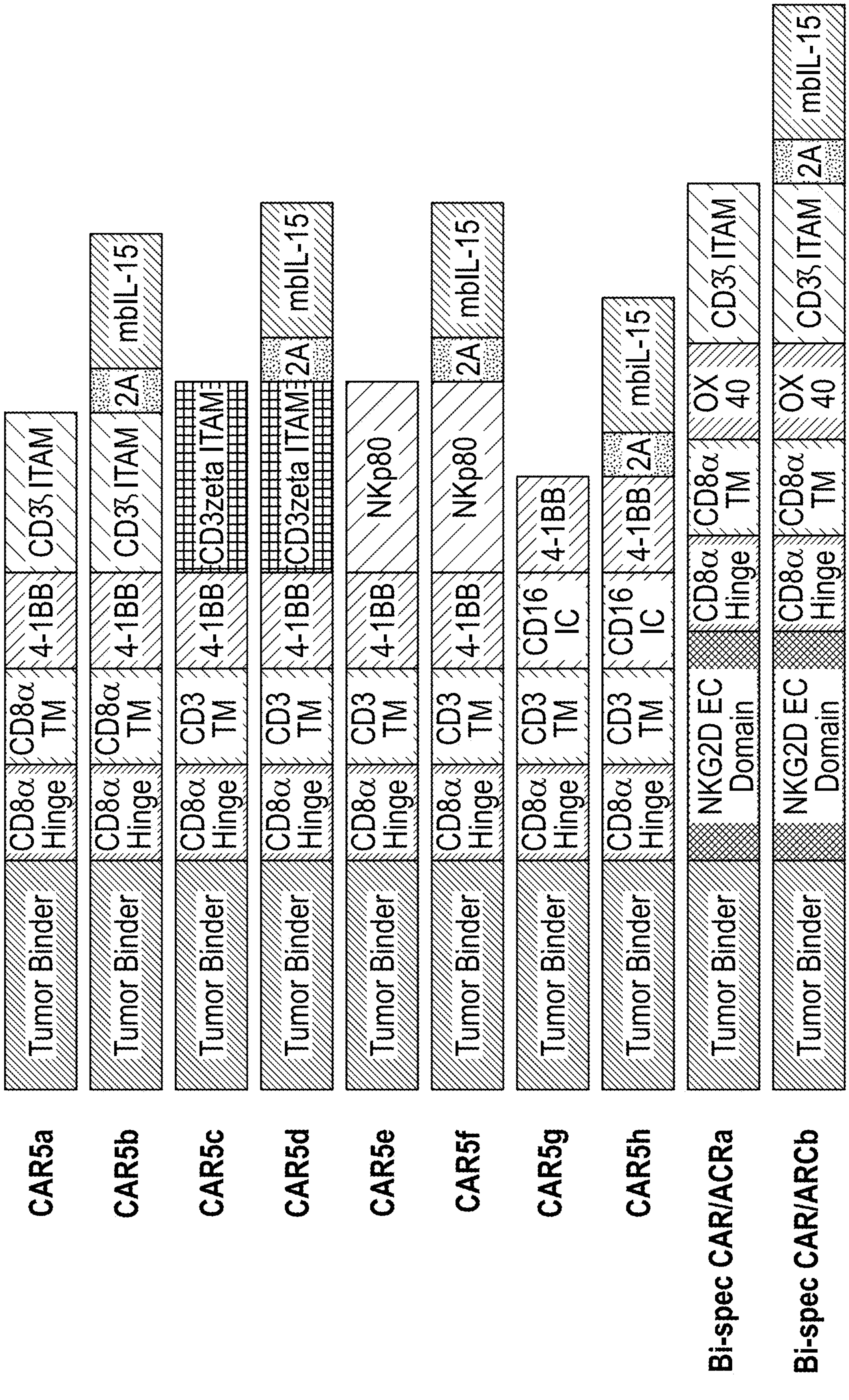
FIG. 5 depicts additional non-limiting schematics of tumor-directed chimeric antigen receptors.

In several embodiments, there is provided a polynucleotide encoding a Tumor Binder/CD8 alpha hinge/CD8 alpha TM/4-1 BB/CD3zeta chimeric antigen receptor complex (see FIG. 5, CAR5a). The polynucleotide comprises or is composed of a Tumor Binder, a CD8a hinge, a CD8a transmembrane domain, a 4-1 BB domain, and a CD3zeta domain as described herein. In several embodiments, the polynucleotide further encodes mbIL15 (see FIG. 5, CAR5b). In several embodiments, this receptor complex is encoded by a nucleic acid molecule comprising a sequence obtained from a combination of sequences disclosed herein, or comprises an amino acid sequence obtained from a combination of sequences disclosed herein. In several embodiments, the encoding nucleic acid sequence, or the amino acid sequence, comprises a sequence in accordance with one or more SEQ ID NOS as described herein, such as those included herein as examples of constituent parts. In several embodiments, the encoding nucleic acid sequence, or the amino acid sequence, comprises a sequence that shares at least about 90%, at least about 94%, at least about 95%, at least about 96%, at least about 97%, at least about 98%, or at least about 99%, sequence identity, homology and/or functional equivalence with a sequence resulting from the combination one or more SEQ ID NOS as described herein. It shall be appreciated that certain sequence variability, extensions, and/or truncations of the disclosed sequences may result when combining sequences, as a result of, for example, ease or efficiency in cloning (e.g., for creation of a restriction site).

In several embodiments, there is provided a polynucleotide encoding a Tumor Binder/CD8 alpha hinge/CD3 TM/4-1 BB/CD3zeta chimeric antigen receptor complex (see FIG. 5, CAR5c). The polynucleotide comprises or is composed of a Tumor Binder, a CD8a hinge, a CD3 transmembrane domain, a 4-1 BB domain, and a CD3zeta domain as described herein. In several embodiments, the polynucleotide further encodes mbIL15 (see FIG. 5, CAR5d). In several embodiments, this receptor complex is encoded by a nucleic acid molecule comprising a sequence obtained from a combination of sequences disclosed herein, or comprises an amino acid sequence obtained from a combination of sequences disclosed herein. In several embodiments, the encoding nucleic acid sequence, or the amino acid sequence, comprises a sequence in accordance with one or more SEQ ID NOS as described herein, such as those included herein as examples of constituent parts. In several embodiments, the encoding nucleic acid sequence, or the amino acid sequence, comprises a sequence that shares at least about 90%, at least about 94%, at least about 95%, at least about 96%, at least about 97%, at least about 98%, or at least about 99%, sequence identity, homology and/or functional equivalence with a sequence resulting from the combination one or more SEQ ID NOS as described herein. It shall be appreciated that certain sequence variability, extensions, and/or truncations of the disclosed sequences may result when combining sequences, as a result of, for example, ease or efficiency in cloning (e.g., for creation of a restriction site).

In several embodiments, there is provided a polynucleotide encoding a Tumor Binder/CD8 alpha hinge/CD3 TM/4-1BB/NKp80 chimeric antigen receptor complex (see FIG. 5, CAR5e). The polynucleotide comprises or is composed of a Tumor Binder, a CD8a hinge, a CD3 transmembrane domain, a 4-1 BB domain, and an NKp80 domain as described herein. In several embodiments, the polynucleotide further encodes mbIL15 (see FIG. 5, CAR5f). In several embodiments, this receptor complex is encoded by a nucleic acid molecule comprising a sequence obtained from a combination of sequences disclosed herein, or comprises an amino acid sequence obtained from a combination of sequences disclosed herein.

In several embodiments, the encoding nucleic acid sequence, or the amino acid sequence, comprises a sequence in accordance with one or more SEQ ID NOS as described herein, such as those included herein as examples of constituent parts. In several embodiments, the encoding nucleic acid sequence, or the amino acid sequence, comprises a sequence that shares at least about 90%, at least about 94%, at least about 95%, at least about 96%, at least about 97%, at least about 98%, or at least about 99%, sequence identity, homology and/or functional equivalence with a sequence resulting from the combination one or more SEQ ID NOS as described herein. It shall be appreciated that certain sequence variability, extensions, and/or truncations of the disclosed sequences may result when combining sequences, as a result of, for example, ease or efficiency in cloning (e.g., for creation of a restriction site).

In several embodiments, there is provided a polynucleotide encoding a Tumor Binder/CD8 alpha hinge/CD3 TM/CD16 intracellular domain/4-1BB chimeric antigen receptor complex (see FIG. 5, CAR5g). The polynucleotide comprises or is composed of a Tumor Binder, a CD8a hinge, a CD3 transmembrane domain, CD16 intracellular domain, and a 4-1 BB domain as described herein. In several embodiments, the polynucleotide further encodes mbIL15 (see FIG. 5, CAR5h). In several embodiments, this receptor complex is encoded by a nucleic acid molecule comprising a sequence obtained from a combination of sequences disclosed herein, or comprises an amino acid sequence obtained from a combination of sequences disclosed herein. In several embodiments, the encoding nucleic acid sequence, or the amino acid sequence, comprises a sequence in accordance with one or more SEQ ID NOS as described herein, such as those included herein as examples of constituent parts. In several embodiments, the encoding nucleic acid sequence, or the amino acid sequence, comprises a sequence that shares at least about 90%, at least about 94%, at least about 95%, at least about 96%, at least about 97%, at least about 98%, or at least about 99%, sequence identity, homology and/or functional equivalence with a sequence resulting from the combination one or more SEQ ID NOS as described herein. It shall be appreciated that certain sequence variability, extensions, and/or truncations of the disclosed sequences may result when combining sequences, as a result of, for example, ease or efficiency in cloning (e.g., for creation of a restriction site).

In several embodiments, there is provided a polynucleotide encoding a Tumor Binder/NKG2D Extracellular Domain/CD8hinge-CD8TM/OX40/CD3zeta chimeric antigen receptor complex (see FIG. 5, Bi-spec CAR/ACRa). The polynucleotide comprises or is composed of a Tumor Binder, an NKG2D extracellular domain (either full length or a fragment), a CD8a hinge, a CD8a transmembrane domain, an OX40 domain, and a CD3zeta domain as described herein. In several embodiments, the polynucleotide further encodes mbIL15 (see FIG. 5, Bi-Spec CAR/ACRb). In several embodiments, this receptor complex is encoded by a nucleic acid molecule comprising a sequence obtained from a combination of sequences disclosed herein, or comprises an amino acid sequence obtained from a combination of sequences disclosed herein. In several embodiments, the encoding nucleic acid sequence, or the amino acid sequence, comprises a sequence in accordance with one or more SEQ ID NOS as described herein, such as those included herein as examples of constituent parts. In several embodiments, the encoding nucleic acid sequence, or the amino acid sequence, comprises a sequence that shares at least about 90%, at least about 94%, at least about 95%, at least about 96%, at least about 97%, at least about 98%, or at least about 99%, sequence identity, homology and/or functional equivalence with a sequence resulting from the combination one or more SEQ ID NOS as described herein. It shall be appreciated that certain sequence variability, extensions, and/or truncations of the disclosed sequences may result when combining sequences, as a result of, for example, ease or efficiency in cloning (e.g., for creation of a restriction site).

In several embodiments, there is provided a polynucleotide encoding an anti-CD70 binding domain/CD8a hinge/CD8a transmembrane domain/OX40/CD3zeta chimeric antigen receptor complex (see FIG. 6, CD70 CARa). The polynucleotide comprises or is composed of an anti-CD70 binding domain, a CD8alpha hinge, a CD8a transmembrane domain, an OX40 domain, and a CD3zeta domain as described herein. In several embodiments, the polynucleotide further encodes mbIL15 (see FIG. 6, CD70CARb). In several embodiments, this anti-CD70 binding domain comprises an scFv. In several embodiments, the anti-CD70 scFv is encoded by a nucleic acid molecule having a sequence according to any one of SEQ ID NOS: 38-111. In several embodiments, the anti-CD70 scFv is encoded by a nucleic acid sequence that shares at least about 80%, at least about 85%, at least about 90%, at least about 95%, at least about 96%, at least about 97%, at least about 98%, or at least about 99%, sequence identity, homology and/or functional equivalence with any one of SEQ ID NOS: 38-111. In several embodiments, the scFv comprises an amino acid having at least about 80%, at least about 85%, at least about 90%, at least about 95%, at least about 96%, at least about 97%, at least about 98%, or at least about 99%, sequence identity, homology and/or functional equivalence with any one of SEQ ID NOS: 230-303. In several embodiments, an anti-CD70 CAR is encoded by a nucleic acid sequence that shares at least about 80%, at least about 85%, at least about 90%, at least about 95%, at least about 96%, at least about 97%, at least about 98%, or at least about 99%, sequence identity, homology and/or functional equivalence with any one of SEQ ID NOS: 138-211 or a portion thereof (e.g. a portion excluding the mbIL15 sequence and/or self-cleaving peptide sequence). In several embodiments, the anti-CD70 CAR comprises an amino acid sequence having at least about 80%, at least about 85%, at least about 90%, at least about 95%, at least about 96%, at least about 97%, at least about 98%, or at least about 99%, sequence identity, homology and/or functional equivalence with any one of SEQ ID NOS: 313-395, or a portion thereof (e.g. a portion excluding the mbIL15 sequence and/or self-cleaving peptide sequence).

In some embodiments of the CARs disclosed herein, the CAR comprises at least two anti-CD70 binding domains and the CAR is a multivalent CAR. In some embodiments, the multivalent CAR comprises two anti-CD70 binding domains and the CAR is a bivalent CAR.

In some embodiments, the bivalent CAR comprises a first anti-CD70 binding domain and a second anti-CD70 binding domain. In some embodiments, the first anti-CD70 binding domain and the second anti-CD70 binding domain are any one of the anti-CD70 binding domains disclosed herein. In some embodiments, the first anti-CD70 binding domain and the second anti-CD70 binding domain each comprise a heavy chain variable region and a light chain variable region disclosed herein. In some embodiments, the first anti-CD70 binding domain and the second anti-CD70 binding domain each comprise: a) a heavy chain variable region comprising the sequence of SEQ ID NO: 923 and a light chain variable region comprising the sequence of SEQ ID NO: 997; b) a heavy chain variable region comprising the sequence of SEQ ID NO: 949 and a light chain variable region comprising the sequence of SEQ ID NO: 1023; c) a heavy chain variable region comprising the sequence of SEQ ID NO: 950 and a light chain variable region comprising the sequence of SEQ ID NO: 1024; d) a heavy chain variable region comprising the sequence of SEQ ID NO: 952 and a light chain variable region comprising the sequence of SEQ ID NO: 1026; or e) a heavy chain variable region comprising the sequence of SEQ ID NO: 953 and a light chain variable region comprising the sequence of SEQ ID NO: 1027.

In several embodiments, there is provided a polynucleotide encoding a bi-specific anti-CD70 binding domain/CD8a hinge/CD8a transmembrane domain/OX40/CD3zeta chimeric antigen receptor complex (see FIG. 6, Bi-V CD70 CARa). The polynucleotide comprises or is composed of a first and a second anti-CD70 binding domain, a CD8alpha hinge, a CD8a transmembrane domain, an OX40 domain, and a CD3zeta domain as described herein. In several embodiments, the polynucleotide further encodes mbIL15 (see FIG. 6, Bi-V CD70CARb). In several embodiments, the first and/or the second anti-CD70 binding domain comprise an scFv. In several embodiments the first and the second anti-CD70 scFv are the same, while in some embodiments the first and the second anti-CD70 scFv are different sequences. In several embodiments, the bi-specific anti-CD70 scFv is encoded by a nucleic acid molecule having a sequence according to any one of SEQ ID NOS: 112-120, and/or 221-229. In several embodiments, the anti-CD70 scFv is encoded by a nucleic acid sequence that shares at least about 80%, at least about 85%, at least about 90%, at least about 95%, at least about 96%, at least about 97%, at least about 98%, or at least about 99%, sequence identity, homology and/or functional equivalence with any one of SEQ ID NOS: 112-120, and/or 221-229. In several embodiments, the bispecific scFv comprises an amino acid having at least about 80%, at least about 85%, at least about 90%, at least about 95%, at least about 96%, at least about 97%, at least about 98%, or at least about 99%, sequence identity, homology and/or functional equivalence with any one of SEQ ID NOS: 304-312, 890-963, and/or 964-1037. In several embodiments, a bispecific anti-CD70 CAR is encoded by a nucleic acid sequence that shares at least about 80%, at least about 85%, at least about 90%, at least about 95%, at least about 96%, at least about 97%, at least about 98%, or at least about 99%, sequence identity, homology and/or functional equivalence with any one of SEQ ID NOS: 212-220, or codon-optimized SEQ ID NOs: 221-229. In several embodiments, the bispecific CAR comprises an amino acid sequence having at least about 80%, at least about 85%, at least about 90%, at least about 95%, at least about 96%, at least about 97%, at least about 98%, or at least about 99%, sequence identity, homology and/or functional equivalence with any one of SEQ ID NOS: 387-395, or a portion thereof (e.g. a portion excluding the mbIL15 sequence and/or self-cleaving peptide sequence).

In several embodiments, there is provided a polynucleotide encoding an anti-CD70 scFv/CD8a hinge/CD8a transmembrane domain/OX40/CD3zeta chimeric antigen receptor complex (see FIG. 6, NK71). The polynucleotide comprises or is composed of an anti CD70 scFv encoded by a nucleic acid sequence that shares at least about 80%, at least about 85%, at least about 90%, at least about 95%, at least about 96%, at least about 97%, at least about 98%, or at least about 99%, sequence identity, homology and/or functional equivalence with SEQ ID NO: 36, a CD8alpha hinge, a CD8a transmembrane domain, an OX40 domain, and a CD3zeta domain as described herein. In several embodiments, the polynucleotide further encodes mbIL15. In several embodiments, there is provided a polynucleotide encoding an anti CD70 scFv/CD8a hinge/CD8a transmembrane domain/OX40/CD3zeta chimeric antigen receptor complex (see FIG. 6, NK72). The polynucleotide comprises or is composed of an anti CD70 scFv encoded by a nucleic acid sequence that shares at least about 80%, at least about 85%, at least about 90%, at least about 95%, at least about 96%, at least about 97%, at least about 98%, or at least about 99%, sequence identity, homology and/or functional equivalence with SEQ ID NO: 37, a CD8alpha hinge, a CD8a transmembrane domain, an OX40 domain, and a CD3zeta domain as described herein. In several embodiments, the polynucleotide further encodes mbIL15. However, in several embodiments, the anti-CD70 CARs disclosed herein do not comprise the scFv of SEQ ID NO: 36 or 37.

In several embodiments, there is provided a polynucleotide encoding an CD19/CD8a hinge/CD8a transmembrane domain/OX40/CD3zeta activating chimeric receptor complex (see FIG. 7, CD19 CARa). The polynucleotide comprises or is composed of an anti-CD19 scFv, a CD8alpha hinge, a CD8a transmembrane domain, an OX40 domain, and a CD3zeta domain as described herein. Additionally, in several embodiments, the polynucleotide encoding this CAR construct can optionally further encode mbIL15 (FIG. 7, CD19 CARb). In several embodiments, this receptor complex (including mbIL15) is encoded by a nucleic acid molecule comprising the nucleic acid sequence of SEQ ID NO: 34. In yet another embodiment, this chimeric receptor is encoded by the amino acid sequence of SEQ ID NO: 35. In some embodiments, the sequence of the chimeric receptor may vary from SEQ ID NO: 34 or 35, but remains, depending on the embodiment, at least 70%, at least 75%, at least 80%, at least 85%, at least 90%, or at least 95% identical with SEQ ID NO: 34 or 35. In several embodiments, while the chimeric receptor may vary from SEQ ID NO: 34 or 35, the chimeric receptor retains, or in some embodiments, has enhanced, NK cell activating and/or cytotoxic function. Additional information about chimeric receptors for use in the presently disclosed methods and compositions can be found in PCT Patent Application No. PCT/US2020/020824, filed Mar. 3, 2020, which is incorporated in its entirety by reference herein.

In several embodiments, there is provided a polynucleotide encoding an NKG2D/CD8a hinge/CD8a transmembrane domain/OX40/CD3zeta activating chimeric receptor complex (see FIG. 7, NKG2D ACRa). The polynucleotide comprises or is composed of a fragment of the NKG2D receptor capable of binding a ligand of the NKG2D receptor, a CD8alpha hinge, a CD8a transmembrane domain, an OX40 domain, and a CD3zeta domain as described herein. In several embodiments, this receptor complex is encoded by a nucleic acid molecule comprising the nucleic acid sequence of SEQ ID NO: 32. In yet another embodiment, this chimeric receptor is encoded by the amino acid sequence of SEQ ID NO: 33. In some embodiments, the sequence of the chimeric receptor may vary from SEQ ID NO: 32 or 33, but remains, depending on the embodiment, at least 70%, at least 75%, at least 80%, at least 85%, at least 90%, or at least 95% identical to SEQ ID NO: 32 or 33. In several embodiments, while the chimeric receptor may vary from SEQ ID NO: 32 or 33, the chimeric receptor retains, or in some embodiments, has enhanced, NK cell activating and/or cytotoxic function. Additionally, in several embodiments, this construct can optionally be co-expressed with mbIL15, such as the mbIL15 encoded by SEQ ID NO: 1188 (FIG. 7, NKG2D ACRb). Additional information about chimeric receptors for use in the presently disclosed methods and compositions can be found in PCT Patent Publication No. WO 2018/183385, filed Mar. 27, 2018, which is incorporated in its entirety by reference herein.

In several embodiments, there is provided a population of genetically engineered natural killer cells for cancer immunotherapy. In some embodiments, the population comprises a plurality of NK cells that have been expanded in culture. In some embodiments, at least a portion of the plurality of NK cells is engineered to express a chimeric antigen receptor comprising a tumor binding domain, a transmembrane domain, and a cytotoxic signaling complex. In some embodiments, the tumor binding domain targets CD70 and is encoded by a polynucleotide comprising a sequence having at least 85%, at least 90%, or at least 95% sequence identity to SEQ ID NO: 36 or 37. In some embodiments, the tumor binding domain targets CD70 and comprises an amino acid sequence having at least 85%, at least 90%, or at least 95% or greater sequence identity to SEQ ID NO: 1186 or 1187. In some embodiments, the NK cells are genetically edited to express reduced levels of CD70 as compared to a non-edited NK cell that has been expanded in culture. In some embodiments, the reduced CD70 expression was engineered through editing of an endogenous CD70 gene. In some embodiments, the NK cells are further genetically edited to express reduced levels of a CIS protein encoded by a CISH gene as compared to a non-engineered NK cell. In some embodiments, the reduced CIS expression was engineered through editing of a CISH gene. In some embodiments, the genetically engineered NK cells exhibit one or more of enhanced expansion capability, enhanced cytotoxicity against target cells, and enhanced persistence, as compared to NK cells expressing native levels of CIS. In some embodiments, the NK cells are further genetically edited to express reduced levels of an adenosine receptor. In some embodiments, the reduced adenosine receptor expression was achieved through editing of a gene encoding said adenosine receptor. In some embodiments, the genetically engineered NK cells exhibit one or more of enhanced expansion capability, enhanced cytotoxicity against target cells and enhanced persistence, as compared to NK cells expressing native levels of the adenosine receptor.

Also disclosed herein are cells comprising any one of the anti-CD70 binding domains disclosed herein and/or any one of the CARs disclosed herein. In some embodiments, the cell is an immune cell. In some embodiments, the cell is an NK cell or a T cell. In some embodiments, the cell is genetically edited to express a reduced level of CISH, an adenosine receptor, A2A adenosine receptor, A2B adenosine receptor, A3 adenosine receptor, A1 adenosine receptor, A2AR, TGFBR, B2M, CIITA, NKG2A, CBLB, TRIM29, SOCS2, SMAD3, MAPKAPK3, CEACAM1, or DDIT4, or any combination thereof, as compared to a non-engineered cell. In some embodiments, the cell is genetically edited with one or more guide RNAs having at least 95% sequence identity to SEQ ID NOs: 1190-1201. Unless indicated otherwise to the contrary, the sequences provided for guide RNAs that are recited using deoxyribonucleotides refer to the target DNA and shall be considered as also referencing those guides used in practice (e.g., employing ribonucleotides, where the ribonucleotide uracil is used in lieu of deoxyribonucleotide thymine or vice-versa where thymine is used in lieu of uracil, wherein both are complementary base pairs to adenine when reciting either an RNA or DNA sequence). For example, a gRNA with the sequence TCACCAAGCCCGCGACCAATGGG (SEQ ID NO: 121) shall also refer to the following sequence UCACCAAGCCCGCGACCAAUGGG (SEQ ID NO: 1214) or a gRNA with sequence UCACCAAGCCCGCGACCAAUGGG (SEQ ID NO: 1214) shall also refer to the following sequence TCACCAAGCCCGCGACCAATGGG (SEQ ID NO: 121).

Methods of Treatment

Some embodiments relate to a method of treating, ameliorating, inhibiting, or preventing cancer with a cell or immune cell comprising a chimeric antigen receptor and/or an activating chimeric receptor, as disclosed herein. In some embodiments, the method includes treating or preventing cancer. In some embodiments, the method includes administering a therapeutically effective amount of immune cells expressing a tumor-directed chimeric antigen receptor and/or tumor-directed chimeric receptor as described herein. Examples of types of cancer that may be treated as such are described herein.

Disclosed herein are methods of treating cancer in a subject. In some embodiments, the methods comprise administering to the subject any one of the anti-CD70 binding domains disclosed herein, any one of the CARs disclosed herein, or any one of the cells disclosed herein, or any combination thereof.

In certain embodiments, treatment of a subject with a genetically engineered cell(s) described herein achieves one, two, three, four, or more of the following effects, including, for example: (i) reduction or amelioration the severity of disease or symptom associated therewith; (ii) reduction in the duration of a symptom associated with a disease; (iii) protection against the progression of a disease or symptom associated therewith; (iv) regression of a disease or symptom associated therewith; (v) protection against the development or onset of a symptom associated with a disease; (vi) protection against the recurrence of a symptom associated with a disease; (vii) reduction in the hospitalization of a subject; (viii) reduction in the hospitalization length; (ix) an increase in the survival of a subject with a disease; (x) a reduction in the number of symptoms associated with a disease; (xi) an enhancement, improvement, supplementation, complementation, or augmentation of the prophylactic or therapeutic effect(s) of another therapy. Advantageously, the non-alloreactive engineered T cells disclosed herein further enhance one or more of the above. Administration can be by a variety of routes, including, without limitation, intravenous, intra-arterial, subcutaneous, intramuscular, intrahepatic, intraperitoneal and/or local delivery to an affected tissue.

Also disclosed herein are uses of any one of the anti-CD70 binding domains disclosed herein, any one of the CARs disclosed herein, any one of the cells disclosed herein, or any combination thereof for the treatment of cancer.

Also disclosed herein are uses of any one of the anti-CD70 binding domains disclosed herein, any one of the CARs disclosed herein, any one of the cells disclosed herein, or any combination thereof in the manufacture of a medicament for the treatment of cancer.

Administration and Dosing

Further provided herein are methods of treating a subject having cancer, comprising administering to the subject a composition comprising immune cells (such as NK and/or T cells) engineered to express a cytotoxic receptor complex as disclosed herein. For example, some embodiments of the compositions and methods described herein relate to use of a tumor-directed chimeric antigen receptor and/or tumor-directed chimeric receptor, or use of cells expressing a tumor-directed chimeric antigen receptor and/or tumor-directed chimeric receptor, for treating a cancer patient. Uses of such engineered immune cells for treating cancer are also provided.

In certain embodiments, treatment of a subject with a genetically engineered cell(s) described herein achieves one, two, three, four, or more of the following effects, including, for example: (i) reduction or amelioration the severity of disease or symptom associated therewith; (ii) reduction in the duration of a symptom associated with a disease; (iii) protection against the progression of a disease or symptom associated therewith; (iv) regression of a disease or symptom associated therewith; (v) protection against the development or onset of a symptom associated with a disease; (vi) protection against the recurrence of a symptom associated with a disease; (vii) reduction in the hospitalization of a subject; (viii) reduction in the hospitalization length; (ix) an increase in the survival of a subject with a disease; (x) a reduction in the number of symptoms associated with a disease; (xi) an enhancement, improvement, supplementation, complementation, or augmentation of the prophylactic or therapeutic effect(s) of another therapy. Each of these comparisons are versus, for example, a different therapy for a disease, which includes a cell-based immunotherapy for a disease using cells that do not express the constructs disclosed herein. Advantageously, the non-alloreactive engineered T cells disclosed herein further enhance one or more of the above.

Administration can be by a variety of routes, including, without limitation, intravenous, intra-arterial, subcutaneous, intramuscular, intrahepatic, intraperitoneal and/or local delivery to an affected tissue. Doses of immune cells such as NK and/or T cells can be readily determined for a given subject based on their body mass, disease type and state, and desired aggressiveness of treatment, but range, depending on the embodiments, from about $10^5$ cells per kg to about $10^{12}$ cells per kg (e.g., $10^5$-$10^7$, $10^7$-$10^{10}$, $10^{10}$-$10^{12}$ and overlapping ranges therein). In one embodiment, a dose escalation regimen is used. In several embodiments, a range of immune cells such as NK and/or T cells is administered, for example between about $1\times10^6$ cells/kg to about $1\times10^8$ cells/kg. Depending on the embodiment, various types of cancer can be treated. In several embodiments, hepatocellular carcinoma is treated. Additional embodiments provided for herein include treatment or prevention of the following non-limiting examples of cancers including, but not limited to, acute lymphoblastic leukemia (ALL), acute myeloid leukemia (AML), adrenocortical carcinoma, Kaposi sarcoma, lymphoma, gastrointestinal cancer, appendix cancer, central nervous system cancer, basal cell carcinoma, bile duct cancer, bladder cancer, bone cancer, brain tumors (including but not limited to astrocytomas, spinal cord tumors, brain stem glioma, glioblastoma, craniopharyngioma, ependymoblastoma, ependymoma, medulloblastoma, medulloepithelioma), breast cancer, bronchial tumors, Burkitt lymphoma, cervical cancer, colon cancer, chronic lymphocytic leukemia (CLL), chronic myelogenous leukemia (CML), chronic myeloproliferative disorders, ductal carcinoma, endometrial cancer, esophageal cancer, gastric cancer, Hodgkin lymphoma, non-Hodgkin lymphoma, hairy cell leukemia, renal cell cancer, leukemia, oral cancer, nasopharyngeal cancer, liver cancer, lung cancer (including but not limited to, non-small cell lung cancer, (NSCLC) and small cell lung cancer), pancreatic cancer, bowel cancer, lymphoma, melanoma, ocular cancer, ovarian cancer, pancreatic cancer, prostate cancer, pituitary cancer, uterine cancer, and vaginal cancer.

In some embodiments, also provided herein are nucleic acid and amino acid sequences that have sequence identity and/or homology of at least 80%, 85%, 90%, 95%, 96%, 97%, 98%, 99% (and ranges therein) as compared with the respective nucleic acid or amino acid sequences of SEQ ID NOS. 1-398 (or combinations of two or more of SEQ ID NOS: 1-398) and that also exhibit one or more of the functions as compared with the respective SEQ ID NOS. 1-398 (or combinations of two or more of SEQ ID NOS: 1-398) including but not limited to, (i) enhanced proliferation, (ii) enhanced activation, (iii) enhanced cytotoxic activity against cells presenting ligands to which NK cells harboring receptors encoded by the nucleic acid and amino acid sequences bind, (iv) enhanced homing to tumor or infected sites, (v) reduced off target cytotoxic effects, (vi) enhanced secretion of immunostimulatory cytokines and chemokines (including, but not limited to IFNg, TNFa, IL-22, CCL3, CCL4, and CCL5), (vii) enhanced ability to stimulate further innate and adaptive immune responses, and (viii) combinations thereof.

Additionally, in several embodiments, there are provided amino acid sequences that correspond to any of the nucleic acids disclosed herein, while accounting for degeneracy of the nucleic acid code. Furthermore, those sequences (whether nucleic acid or amino acid) that vary from those expressly disclosed herein, but have functional similarity or equivalency are also contemplated within the scope of the present disclosure. The foregoing includes mutants, truncations, substitutions, or other types of modifications.

In several embodiments, polynucleotides encoding the disclosed cytotoxic receptor complexes are mRNA. In some embodiments, the polynucleotide is DNA. In some embodiments, the polynucleotide is operably linked to at least one regulatory element for the expression of the cytotoxic receptor complex.

Additionally provided, according to several embodiments, is a vector comprising the polynucleotide encoding any of the polynucleotides provided for herein, wherein the polynucleotides are optionally operatively linked to at least one regulatory element for expression of a cytotoxic receptor complex. In several embodiments, the vector is a retrovirus.

Further provided herein are engineered immune cells (such as NK and/or T cells) comprising the polynucleotide, vector, or cytotoxic receptor complexes as disclosed herein. Further provided herein are compositions comprising a mixture of engineered immune cells (such as NK cells and/or engineered T cells), each population comprising the polynucleotide, vector, or cytotoxic receptor complexes as disclosed herein. Additionally, there are provided herein compositions comprising a mixture of engineered immune cells (such as NK cells and/or engineered T cells), each population comprising the polynucleotide, vector, or cytotoxic receptor complexes as disclosed herein and the T cell population having been genetically modified to reduce/eliminate gvHD and/or HvD. In some embodiments, the NK cells and the T cells are from the same donor. In some embodiments, the NK cells and the T cells are from different donors. In several embodiments, one or more genes are edited (e.g., knockout or knock in) in order to impart one or more enhanced functions or characteristics to the edited cells. For example, in several embodiments CIS protein is substantially reduced by editing the CISH, which leads to enhanced NK cell proliferation, cytotoxicity and/or persistence.

Doses of immune cells such as NK cells or T cells can be readily determined for a given subject based on their body mass, disease type and state, and desired aggressiveness of treatment, but range, depending on the embodiments, from about $10^5$ cells per kg to about $10^{12}$ cells per kg (e.g., $10^5$-$10^7$, $10^7$-$10^{10}$, $10^{10}$-$10^{12}$ and overlapping ranges therein). In one embodiment, a dose escalation regimen is used. In several embodiments, a range of NK cells is administered, for example between about $1\times10^6$ cells/kg to about $1\times10^8$ cells/kg. Depending on the embodiment, various types of cancer or infection disease can be treated.

Cancer Types

Some embodiments of the compositions and methods described herein relate to administering immune cells comprising a tumor-directed chimeric antigen receptor and/or tumor-directed chimeric receptor to a subject with cancer. Various embodiments provided for herein include treatment or prevention of the following non-limiting examples of cancers. Examples of cancer include, but are not limited to, acute lymphoblastic leukemia (ALL), acute myeloid leukemia (AML), adrenocortical carcinoma, Kaposi sarcoma, lymphoma, gastrointestinal cancer, appendix cancer, central nervous system cancer, basal cell carcinoma, bile duct cancer, bladder cancer, bone cancer, brain tumors (including but not limited to astrocytomas, spinal cord tumors, brain stem glioma, craniopharyngioma, ependymoblastoma, ependymoma, medulloblastoma, medulloepithelioma), breast cancer, bronchial tumors, Burkitt lymphoma, cervical cancer, colon cancer, chronic lymphocytic leukemia (CLL), chronic myelogenous leukemia (CML), chronic myeloproliferative disorders, ductal carcinoma, endometrial cancer, esophageal cancer, gastric cancer, Hodgkin lymphoma, non-Hodgkin lymphoma, hairy cell leukemia, renal cell cancer, leukemia, oral cancer, nasopharyngeal cancer, liver cancer, lung cancer (including but not limited to, non-small cell lung cancer, (NSCLC) and small cell lung cancer), pancreatic cancer, bowel cancer, lymphoma, melanoma, ocular cancer, ovarian cancer, pancreatic cancer, prostate cancer, pituitary cancer, uterine cancer, and vaginal cancer.

Cancer Targets

Some embodiments of the compositions and methods described herein relate to immune cells comprising a chimeric receptor that targets a cancer antigen. Non-limiting examples of target antigens include: CD70, CD5, CD19; CD123; CD22; CD30; CD171; CS1 (also referred to as CD2 subset 1, CRACC, SLAMF7, CD319, and 19A24); TNF receptor family member B cell maturation (BCMA); CD38; DLL3; G protein coupled receptor class C group 5, member D (GPRC5D); epidermal growth factor receptor (EGFR) CD138; prostate-specific membrane antigen (PSMA); Fms Like Tyrosine Kinase 3 (FLT3); KREMEN2 (Kringle Containing Transmembrane Protein 2), ALPPL2, Claudin 4, Claudin 6, C-type lectin-like molecule-1 (CLL-1 or CLECL1); CD33; epidermal growth factor receptor variant III (EGFRviii); ganglioside G2 (GD2); ganglioside GD3 (aNeu5Ac(2-8)aNeu5Ac(2-3)bDGalp(I-4)bDGlcp(I-I) Cer)); Tn antigen ((Tn Ag) or (GaINAca-Ser/Thr)); prostate-specific membrane antigen (PSMA); Receptor tyrosine kinase-like orphan receptor 1 (ROR1); Fms Like Tyrosine Kinase 3 (FLT3); Tumor-associated glycoprotein 72 (TAG72); CD38; CD44v6; a glycosylated CD43 epitope expressed on acute leukemia or lymphoma but not on hematopoietic progenitors, a glycosylated CD43 epitope expressed on non-hematopoietic cancers, Carcinoembryonic antigen (CEA); Epithelial cell adhesion molecule (EP-CAM); B7H3 (CD276); KIT (CD117); Interleukin-13 receptor subunit alpha-2 (IL-13Ra2 or CD213A2); Mesothelin; Interleukin 11 receptor alpha (IL-IIRa); prostate stem cell antigen (PSCA); Protease Serine 21 (Testisin or PRSS21); vascular endothelial growth factor receptor 2 (VEGFR2); Lewis(Y) antigen; CD24; Platelet-derived growth factor receptor beta (PDGFR-beta); Stage-specific embryonic antigen-4 (SSEA-4); CD20; Folate receptor alpha (FRa or FR1); Folate receptor beta (FRb); Receptor tyrosine-protein kinase ERBB2 (Her2/neu); Mucin 1, cell surface associated (MUC1); epidermal growth factor receptor (EGFR); neural cell adhesion molecule (NCAM); Prostase; prostatic acid phosphatase (PAP); elongation factor 2 mutated (ELF2M); Ephrin B2; fibroblast activation protein alpha (FAP); insulin-like growth factor 1 receptor (IGF-I receptor), carbonic anhydrase IX (CAIX); Proteasome (Prosome, Macropain) Subunit, Beta Type, 9 (LMP2); glycoprotein 100 (gp100); oncogene fusion protein consisting of breakpoint cluster region (BCR) and Abelson murine leukemia viral oncogene homolog 1 (AbI) (bcr-abl); tyrosinase; ephrin type-A receptor 2 (EphA2); sialyl Lewis adhesion molecule (sLe); ganglioside GM3 (aNeu5Ac(2-3)bDClalp(I-4)bDGlcp(I-I)Cer); transglutaminase 5 (TGSS); high molecular weight-melanoma associated antigen (HMWMAA); o-acetyl-GD2 ganglioside (OAcGD2); tumor endothelial marker 1 (TEM1/CD248); tumor endothelial marker 7-related (TEM7R); claudin 6 (CLDN6); thyroid stimulating hormone receptor (TSHR); G protein coupled receptor class C group 5, member D (GPRCSD); chromosome X open reading frame 61 (CXORF61); CD97; CD179a; anaplastic lymphoma kinase (ALK); Polysialic acid; placenta-specific 1 (PLAC1); hexasaccharide portion of globoH glycoceramide (GloboH); mammary gland differentiation antigen (NY-BR-1); uroplakin 2 (UPK2); Hepatitis A virus cellular receptor 1 (HAVCR1); adrenoceptor beta 3 (ADRB3); pannexin 3 (PANX3); G protein-coupled receptor 20 (GPR20); lymphocyte antigen 6 complex, locus K 9 (LY6K); Olfactory receptor 51 E2 (OR51E2); TCR Gamma Alternate Reading Frame Protein (TARP); Wilms tumor protein (WT1); Cancer/testis antigen 1 (NY-ESO-1); Cancer/testis antigen 2 (LAGE-la); Melanoma-associated antigen 1 (MAGE-A1); ETS translocation-variant gene 6, located on chromosome 12p (ETV6-AML); sperm protein 17 (SPA17); X Antigen Family, Member 1A (XAGE1); angiopoietin-binding cell surface receptor 2 (Tie 2); melanoma cancer testis antigen-1 (MAD-CT-1); melanoma cancer testis antigen-2 (MAD-CT-2); Fos-related antigen 1; tumor protein p53 (p53); p53 mutant; prostein; survivin; telomerase; prostate carcinoma tumor antigen-1 (PCT A-I or Galectin 8), melanoma antigen recognized by T cells 1 (MelanA or MARTI); Rat sarcoma (Ras) mutant; human Telomerase; reverse transcriptase (hTERT); sarcoma translocation breakpoints; melanoma inhibitor of apoptosis (ML-IAP); ERG (transmembrane protease, serine 2 (TMPRSS2) ETS fusion gene); N-Acetyl glucosaminyl-transferase V (NA17); paired box protein Pax-3 (PAX3); Androgen receptor; Cyclin BI; v-myc avian myelocytomatosis viral oncogene neuroblastoma derived homolog (MYCN); Ras Homolog Family Member C (RhoC); Tyrosinase-related protein 2 (TRP-2); Cytochrome P450 IB 1 (CYPIB 1); CCCTC-Binding Factor (Zinc Finger Protein)-Like (BORIS or Brother of the Regulator oflmprinted Sites), Squamous Cell Carcinoma Antigen Recognized By T Cells 3 (SART3); Paired box protein Pax-5 (PAXS); proacrosin binding protein sp32 (OY-TES1); lymphocyte-specific protein tyrosine kinase (LCK); A kinase anchor protein 4 (AKAP-4); synovial sarcoma, X breakpoint 2 (SSX2); Receptor for Advanced Gly cation Endproducts (RAGE-1); renal ubiquitous 1 (RU1); renal ubiquitous 2 (RU2); legumain; human papilloma virus E6 (HPV E6); human papilloma virus E7 (HPV E7); intestinal carboxyl esterase; heat shock protein 70-2 mutated (mut hsp70-2); CD79a; CD79b; CD72; Leukocyte-associated immunoglobulin-like receptor 1 (LAIR1); Fc fragment of IgA receptor (FCAR or CD89); Leukocyte immunoglobulin-like receptor subfamily A member 2 (LILRA2); CD300 molecule-like family member f (CD300LF); C-type lectin domain family 12 member A (CLEC12A); bone marrow stromal cell antigen 2 (BST2); EGF-like module-containing mucin-like hormone receptor-like 2 (EMR2); lymphocyte antigen 75 (LY75); Glypican-3 (GPC3); Fc receptor-like 5 (FCRLS); and immunoglobulin lambda-like polypeptide 1 (IGLLI), MPL, Biotin, c-MYC epitope Tag, CD34, LAMP1 TROP2, GFRalpha4, CDH17, CDH6, NYBR1, CDH19, CD200R, Slea (CA19.9; Sialyl Lewis Antigen); Fucosyl-GMI, PTK7, gpNMB, CDH1-CD324, DLL3, CD276/B7H3, ILI IRa, IL13Ra2, CD179b-IGLII, TCRgamma-delta, NKG2D, CD32 (FCGR2A), Tn ag, TimI-/HVCR1, CSF2RA (GM-CSFR-alpha), TGFbetaR2, Lews Ag, TCR-betaI chain, TCR-beta2 chain, TCR-gamma chain, TCR-delta chain, FITC, Leutenizing hormone receptor (LHR), Follicle stimulating hormone receptor (FSHR), Gonadotropin Hormone receptor (CGHR or GR), CCR4, GD3, SLAMF6, SLAMF4, HIV1 envelope glycoprotein, HTLVI-Tax, CMV pp65, EBV-EBNA3c, KSHV K8.1, KSHV-gH, influenza A hemagglutinin (HA), GAD, PDL1, Guanylyl cyclase C (GCC), auto antibody to desmoglein 3 (Dsg3), auto antibody to desmoglein 1 (Dsg1), HLA, HLA-A, HLA-A2, HLA-B, HLA-C, HLA-DP, HLA-DM, HLA-DOA, HLA-DOB, HLA-DQ, HLA-DR, HLA-G, IgE, CD99, Ras G12V, Tissue Factor 1 (TF1), AFP, GPRCSD, ClaudinI 8.2 (CLD18A2 or CLDN18A.2)), P-glycoprotein, STEAP1, Livl, Nectin-4, Cripto, gpA33, BST1/CD157, low conductance chloride channel, and the antigen recognized by TNT antibody.

EXAMPLES

The following are non-limiting descriptions of experimental methods and materials that were used in examples disclosed below.

Example 1—CD70 Gene Editing to Reduce Expression by NK Cells

As discussed in more detail herein, certain cancer types express selected markers in an elevated manner. In several embodiments, CAR constructs are generated according to sequences disclosed herein in order to specifically target a given cancer. One such non-limiting embodiment of a cancer marker targeted by constructs disclosed herein is CD70. While various types of cancer can be treated using the cells and methods disclosed herein, in several embodiments renal cell carcinoma (RCC) is treated. RCC accounts for 90-95% of neoplasms in the kidneys, and is one of the most common kidney cancers in adults. While the 5-year survival rate is 75%, this depends heavily on the type, cell type, and stage of the cancer when it is first diagnosed. For ~2/3 of patients, RCC is only in the kidney (with the 5-year survival rate for these patients is 93%). However, if the kidney cancer has spread to surrounding tissues or organs and/or the regional lymph nodes, the 5-year survival rate is drops to 69%. Additionally, if the cancer has spread to a distant part of the body, the 5-year survival rate plummets to only 12%. Therapeutics to treat RCC and other CD70-expressing tumors are needed. Thus, as discussed in detail above, in several embodiments, anti-CD70 CAR constructs are provided. In several embodiments, the polynucleotides encoding those constructs are engineered to bi-cistronically express mbIL15. In several embodiments, however, in order to enhance the expansion, cytotoxicity and/or persistence of engineered immune cells (such as NK cells), the cells are subject to gene editing to enhance or disrupt expression of certain genes. In several embodiments, one such gene that is disrupted, knocked out in several embodiments, is CD70. In several embodiments, CD70 expression is disrupted (e.g., knocked out) in NK cells because NK cells naturally express relatively high levels of CD70, and if expression were maintained at native levels, an anti-CD70 CAR expressing NK cell would target not only a CD70-expressing tumor cell, but also other NK cells (whether native NK cells or those expressing the CD70 CAR). Thus, in several embodiments, gene editing is used to knockout CD70 expression by NK cells, such that engineered NK cells expressing an anti-CD70 CAR are not targeting the therapeutic NK cells as well as a CD70-expressing tumor.

Figures 8A, 8B, 8C:
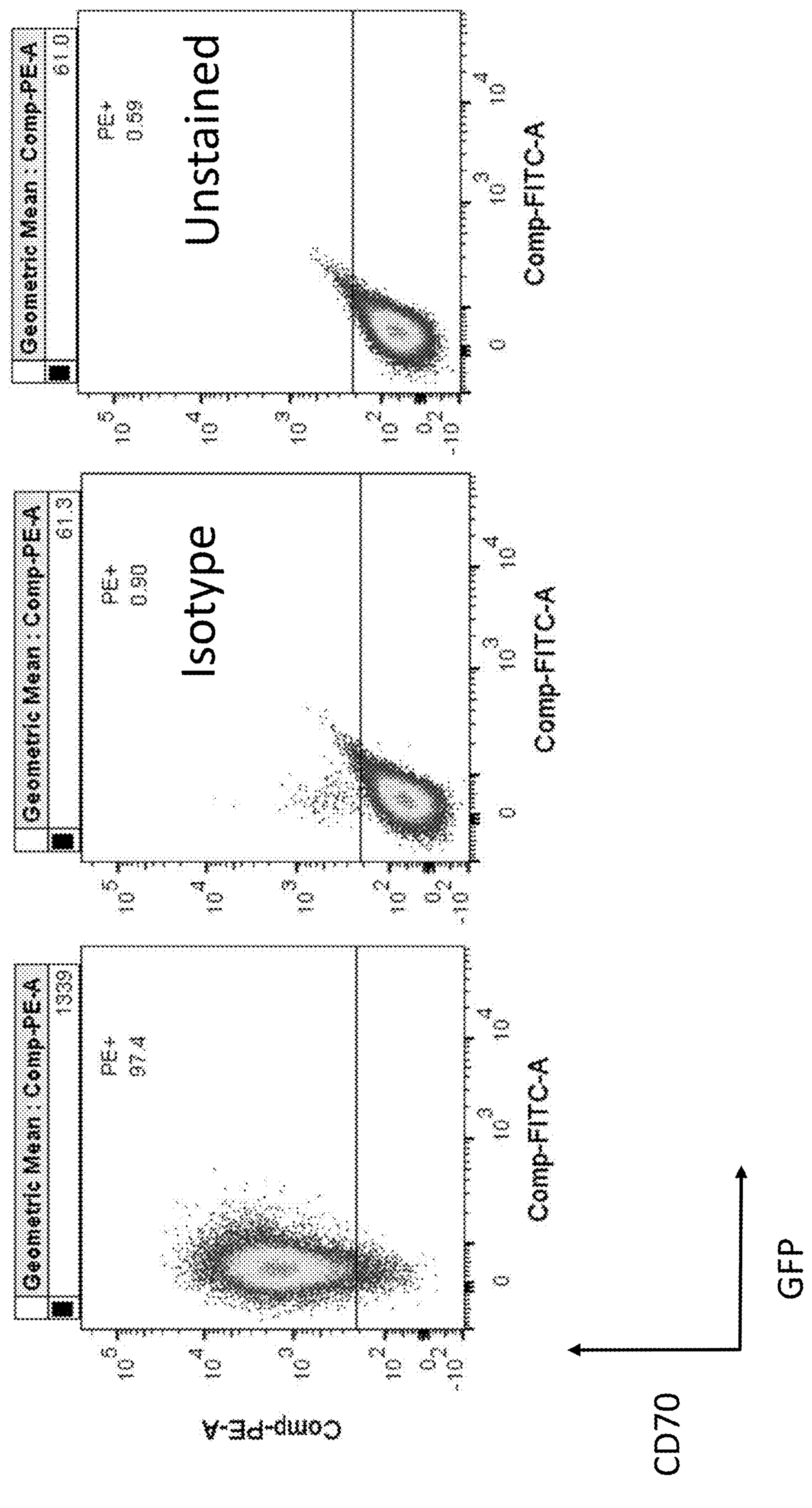
FIGS. 8A-8C show flow cytometry data related to the degree of expression of CD70 by natural killer cells.
Figure 9:
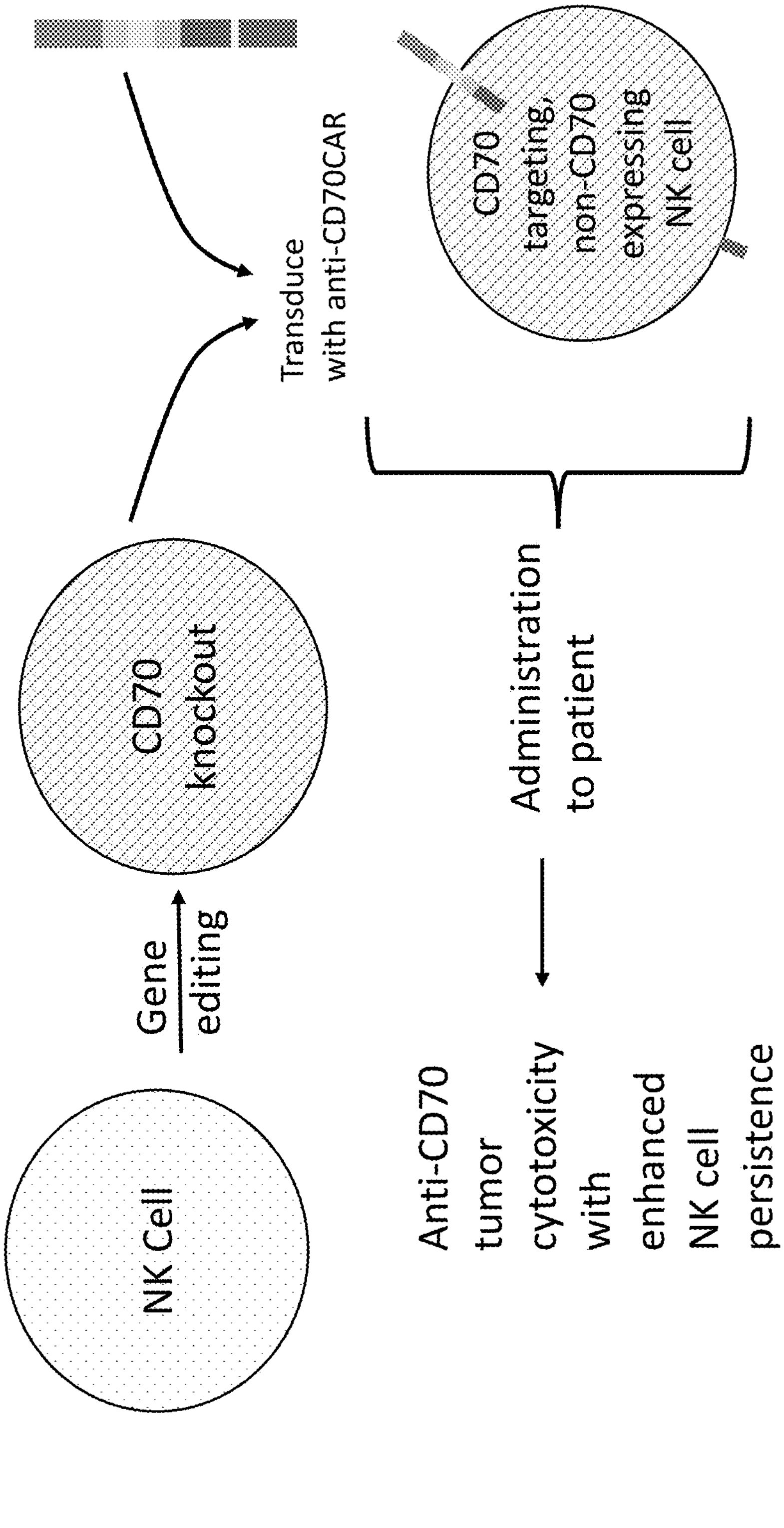
FIG. 9 depicts a non-limiting schematic process flow for generation of engineered NK cells for use therapeutic methods for cancer therapy according to several embodiments disclosed herein.

To assess the expression of CD70 on native NK cell, FACS analysis was performed on donor NK cells after 9 days of expansion in culture. FIGS. 8A-8C show these data. FIG. 8A shows that nearly 98% of NK cells from this donor were positive for CD70. FIGS. 8B and 8C show isotype control staining and unstained NK cells. These data demonstrate that CD70 expression on expanded NK cells would cause an anti-CD70 CAR expressing NK cells to kill the NK cell population, essentially an NK cell suicide due to lack of differentiation between the CD70-expressing NK cells and CD70-expressing tumor cells. FIG. 9 demonstrates a non-limiting schematic of various embodiments of editing and engineering NK cells to effectively target CD70-expressing tumors and exhibit enhanced NK cell persistence. In several embodiments, gene editing is used to reduce, substantially reduce, or eliminate CD70 expression by NK cells. The NK cells are then engineered to express an anti-CD70 CAR, such as those utilizing one or more of the anti-CD70 binding domain or scFv disclosed herein. This process results in a CD70-targeting, non-CD70 expressing NK cell. While this process schematically depicts editing and engineering of NK cells, in several embodiments T cells are subjected to a corresponding process.

Figures 10A, 10B:
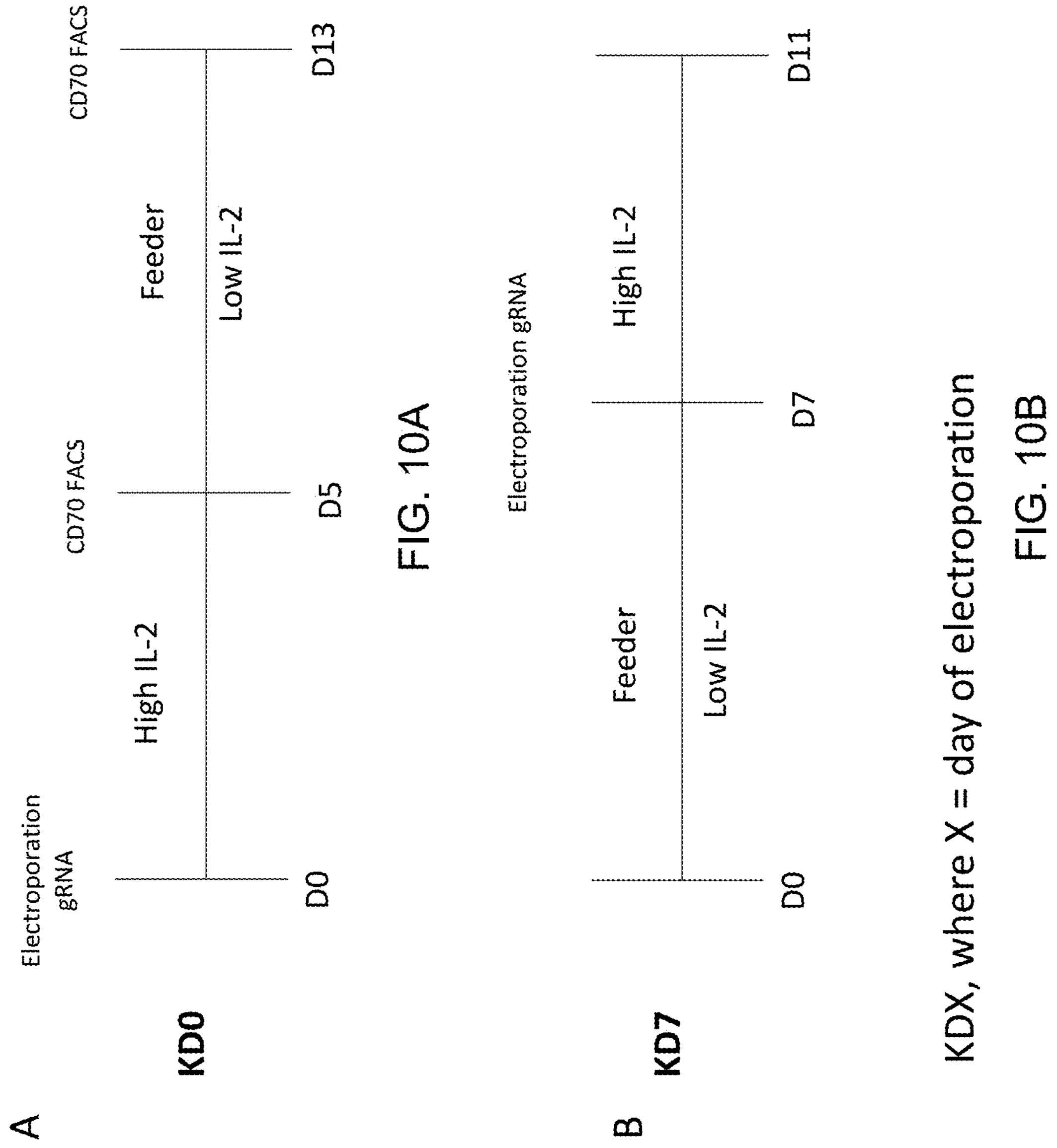
FIGS. 10A-10B show schematics for non-limiting examples of protocols for CRISPR-based modification and culture of engineered NK cells according to several embodiments disclosed herein.

FIGS. 10A and 10B depict schematic process flow diagrams for gene editing of NK cells (or T cells). These non-limiting embodiments of gene editing processes reflect the use of a CRISPR-Cas system, however in several embodiments, other editing modalities are used. FIG. 10A shows a timeline for electroporation of NK cells on Day 0, followed by 5 days of culture in high IL-2 media. At Day 5, CD70 expression is assessed by FACS, followed by another 8 days of expansion of the NK cells in culture with feeder cells and low IL-2 media. CD70 expression is assessed again at Day 13. FIG. 10B shows another non-limiting approach in which NK cells are first expanded by co-culture with feeder cells and using low IL-2 media, followed by electroporation to introduce guide RNA at day 7, then culture in high IL-2 media for 5 additional days. CD70 expression is assessed at Day 7 and Day 11. Non-limiting examples of CD70 guide RNAs are shown below in Table 1.

TABLE 1

CD70 Guide RNAs

| SEQ ID NO: | Name | Sequence |
|---|---|---|
| 121 | CD70-1 | TCACCAAGCCCGCGACCAATGGG |
| 122 | CD70-2 | GCTTTGGTCCCATTGGTCGCGGG |
| 123 | CD70-3 | ACCCTCCTCCGGCATCGCCGCGG |

Figures 11A, 11B:
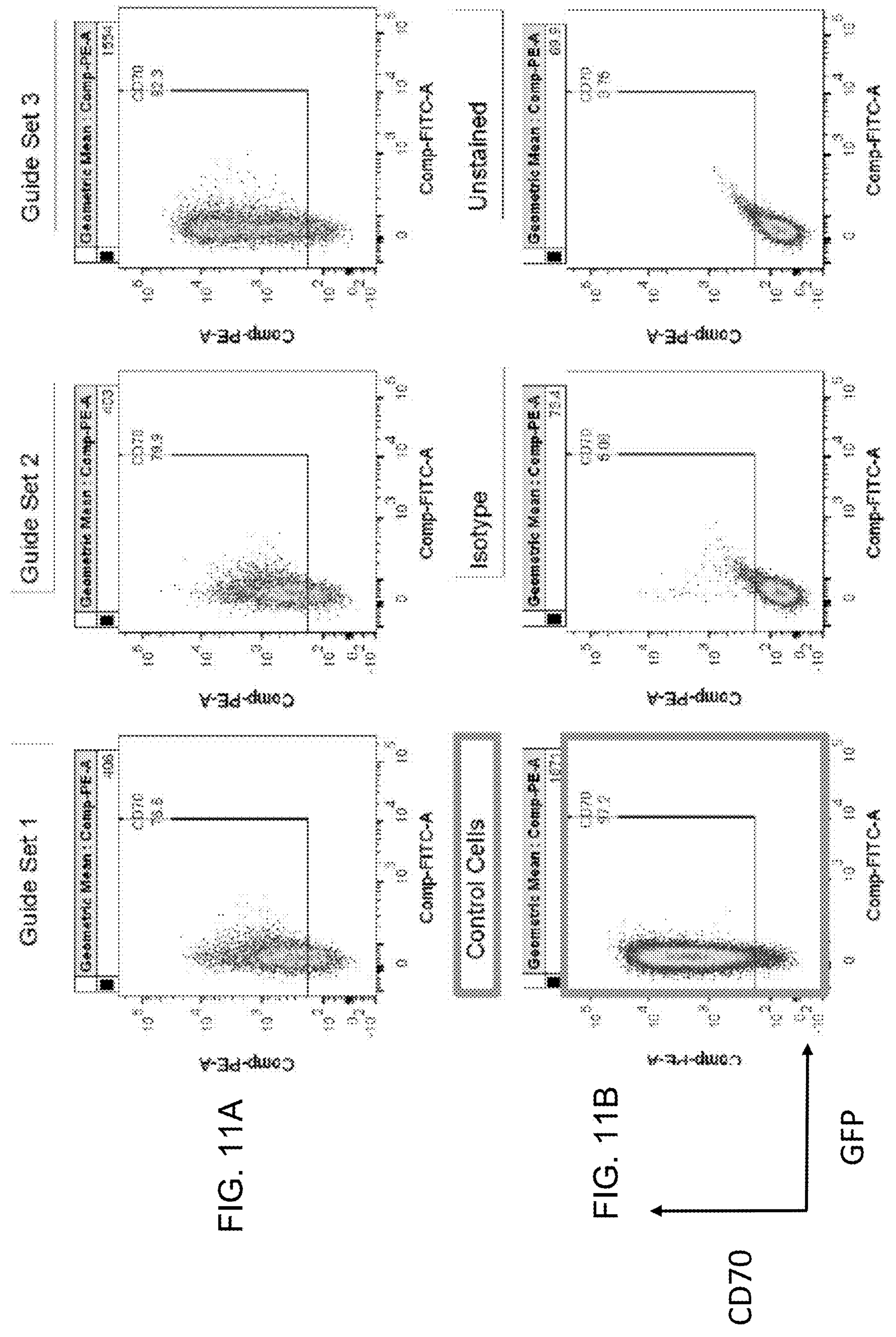
Figures 11, 11D:
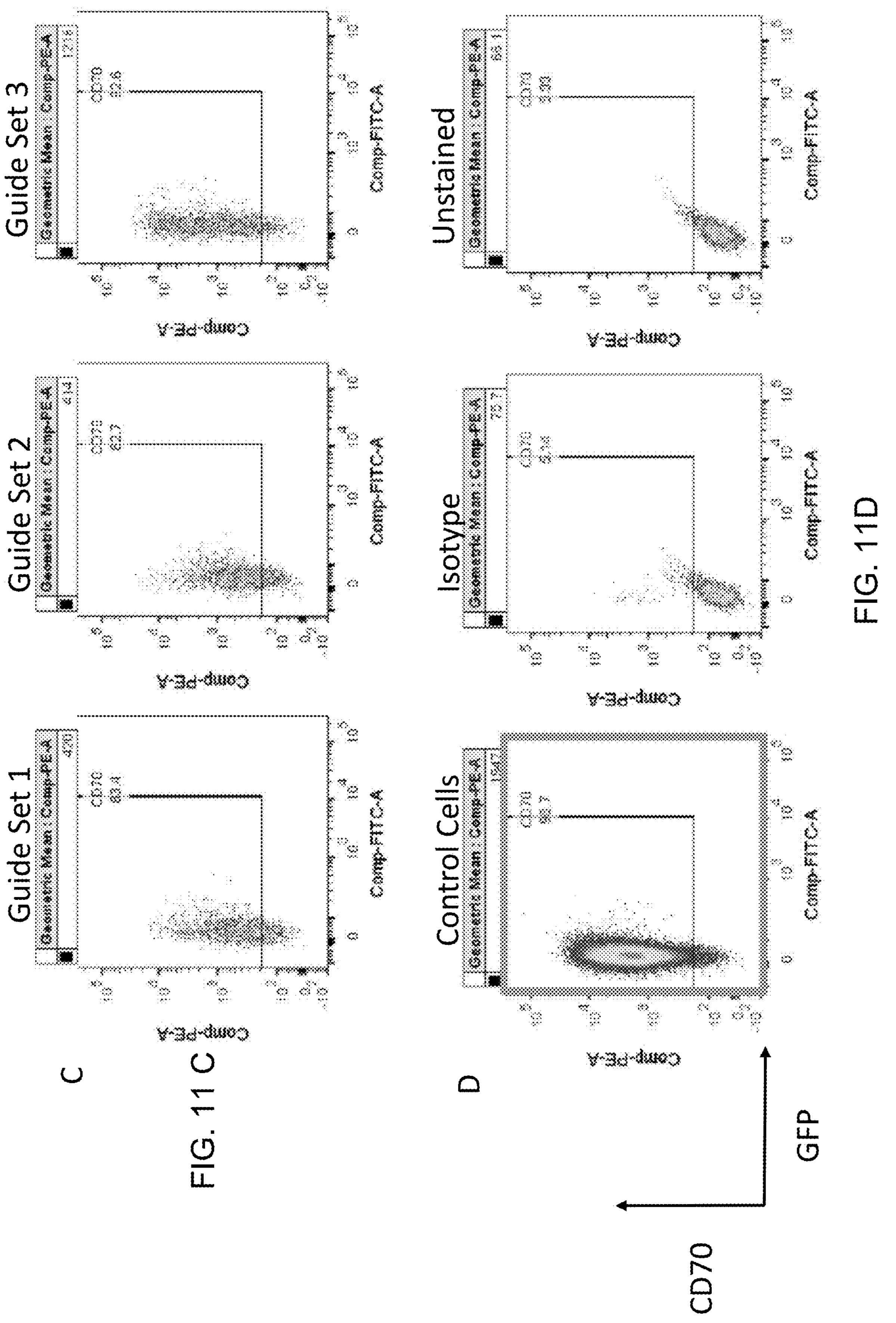

FIGS. 11A-11B show FACS analysis of CD70 expression from a first experiment (using the KD7 approach) and FIGS. 11C-11D show data from a second experiment (also using KD7). FIG. 11A shows CD70 expression for each of the three guide RNAs used, while FIG. 11B shows CD70 expression by native NK cells, an isotype control, and an unstained control. FIGS. 110 and 11D show corresponding data from the second experiment (different donor). While in several embodiments, use of a single guide RNA is sufficient to achieve a desired level of reduced gene/protein expression, given that CD70 expression by edited and engineered immune cells will cause a suicide effect, greater levels of reduction of CD70 were investigated.

Figures 12A, 12B, 12C, 12D, 12E:
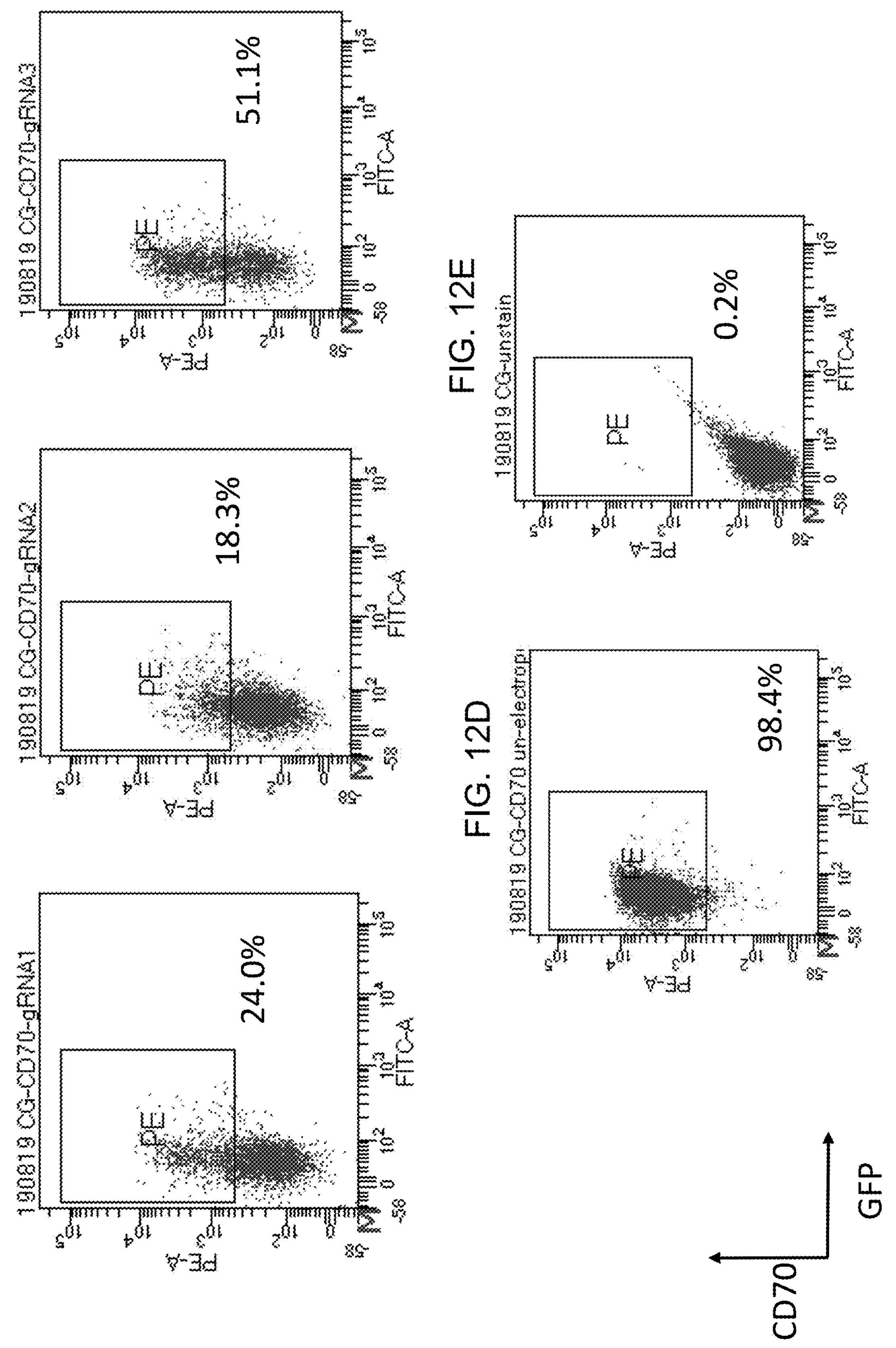
FIGS. 12A-12E show flow cytometry data related to CRISPR-mediated knockdown of CD70 expression on NK cells from an additional donor.
Figures 13A, 13B, 13C, 13D, 13E:
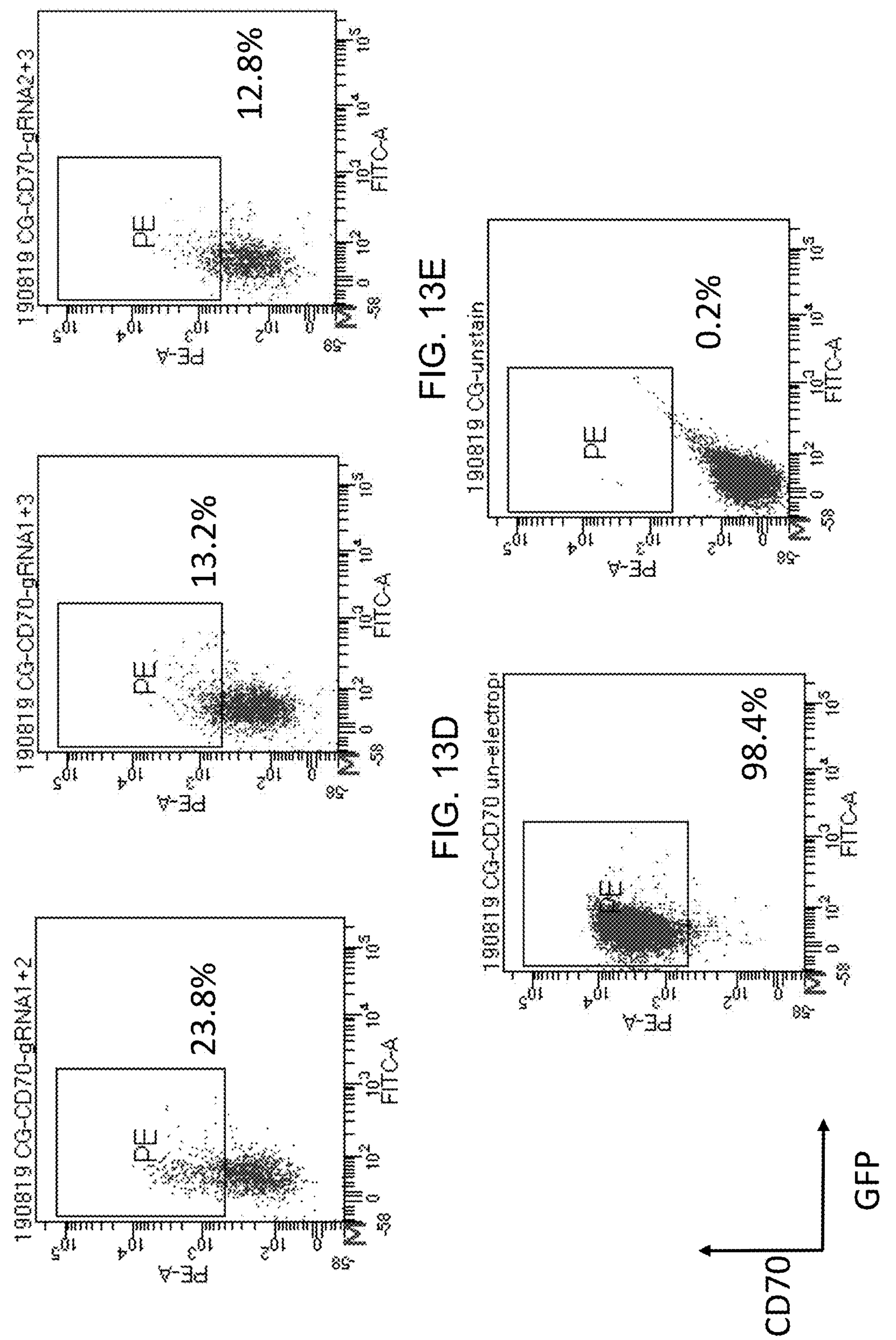
FIGS. 13A-13E show flow cytometry data related to CRISPR-mediated knockdown of CD70 expression on NK cells from the same donor as in FIG. 12 but using combinations of guide RNA.

As is used in several embodiments disclosed herein, the effect of use of single guide RNA versus a combination of guide RNAs was investigated. FIGS. 12A-12E relate to use of single guide RNAs 1, 2, and 3 (12A, 12B, and 12C, respectively). The NK cells in this experiment were edited/expanded with the KD7 method (expansion followed by editing). As shown, approximately 20-50% of the NK cells retained CD70 expression. FIGS. 12D and 12E are CD70 counts on non-electroporated NK cells and an unstained control. FIGS. 13A-13E show data for combinations of guide RNAs (again with KD7). FIG. 13A shows that CD70-1 and CD70-2 guide RNAs in combination reduce CD70 expression to ~24% of NK cells. FIG. 13B shows that CD70-1 and CD70-3 guide RNAs in combination reduce CD70 expression further, to ~13% of NK cells. FIG. 13C shows that CD70-2 and CD70-3 guide RNAs in combination reduce CD70 expression still further, to less than 13% of NK cells. FIGS. 13D and 13E repeat the control data of 12D/12E. These data show that, in accordance with several embodiments, significant reductions in CD70 expression can be accomplished through the use of a plurality of guide RNAs directed against a target gene, like CD70.

Figures 14A, 14B, 14C, 14D, 14E:
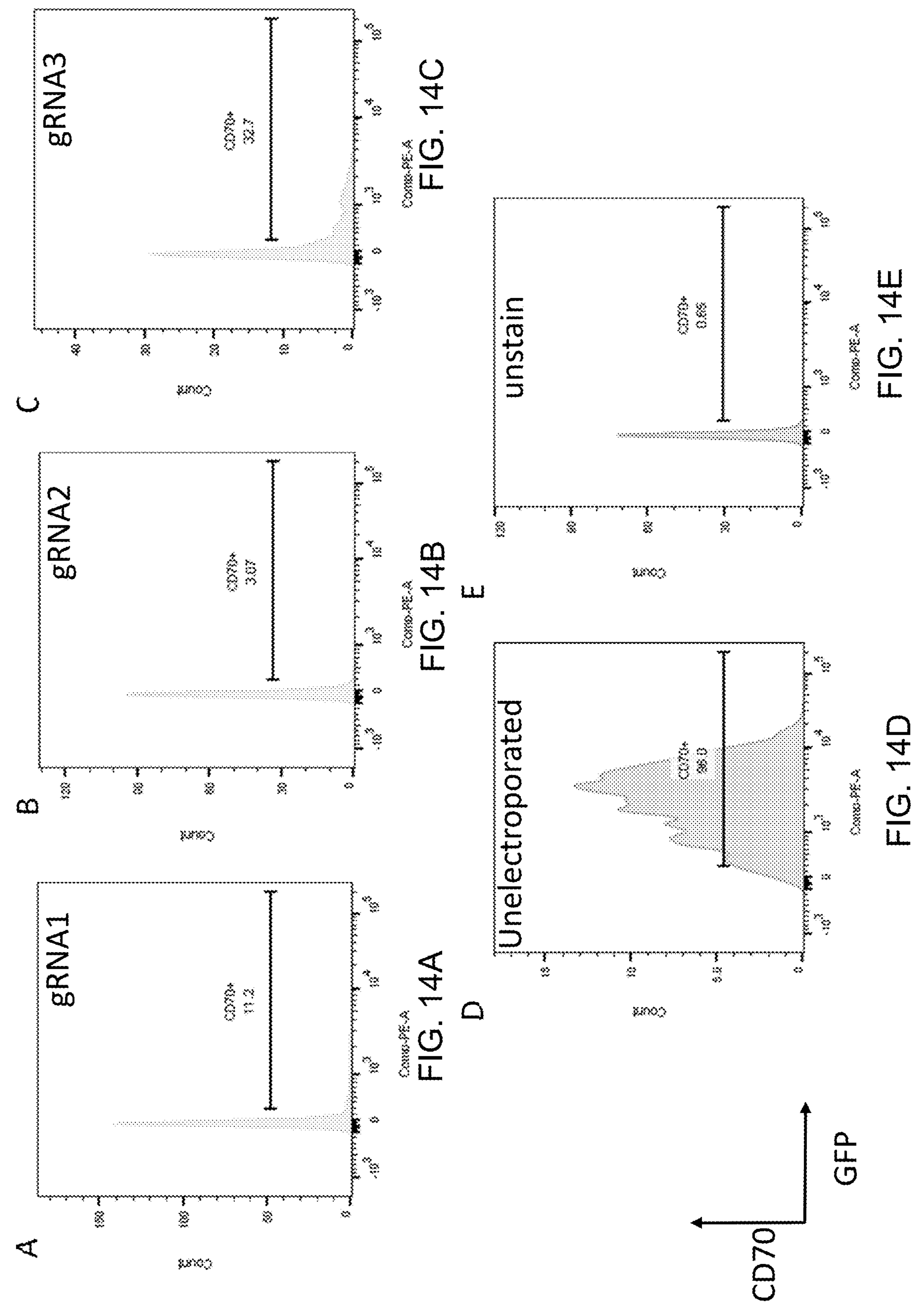
FIGS. 14A-14F show flow cytometry data related to CD70 expression 14 days after CRISPR-mediated CD70 knockout (21 days total).
Figure 14F:
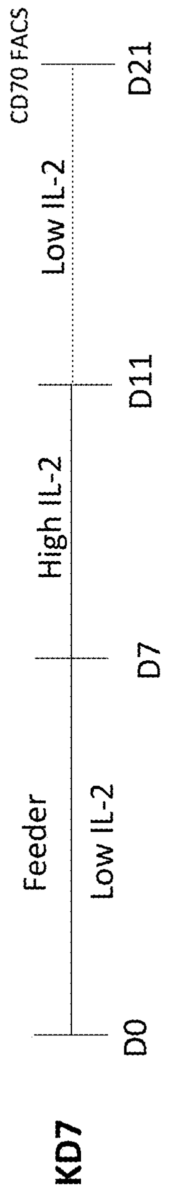

As schematically illustrated in FIG. 14F, provided for herein are various alternative methods for gene editing cells, such as NK cells or T cells. FIG. 14F shows a modified KD7 approach with donor cells being expanded for 7 days, electroporated at Day 7, cultured for 5 days to allow gene editing to occur (done in some embodiments in high IL2 media, followed by an additional 10 days of culture (done in some embodiments with low IL2 media). CD70 expression was analyzed by FACS at Day 21. FIGS. 14A-14E show data related to CD70 expression by NK cells using that approach. FIG. 14D shows CD70 expression on 96% of NK cells assessed, whereas FIG. 14E confirms limited background signal with an unstained population. FIGS. 14A, 14B, and 14C show reductions in CD70 expression by NK cells ranging from about 78% to nearly 97%.

Figures 15A, 15B, 15C, 15D, 15E:
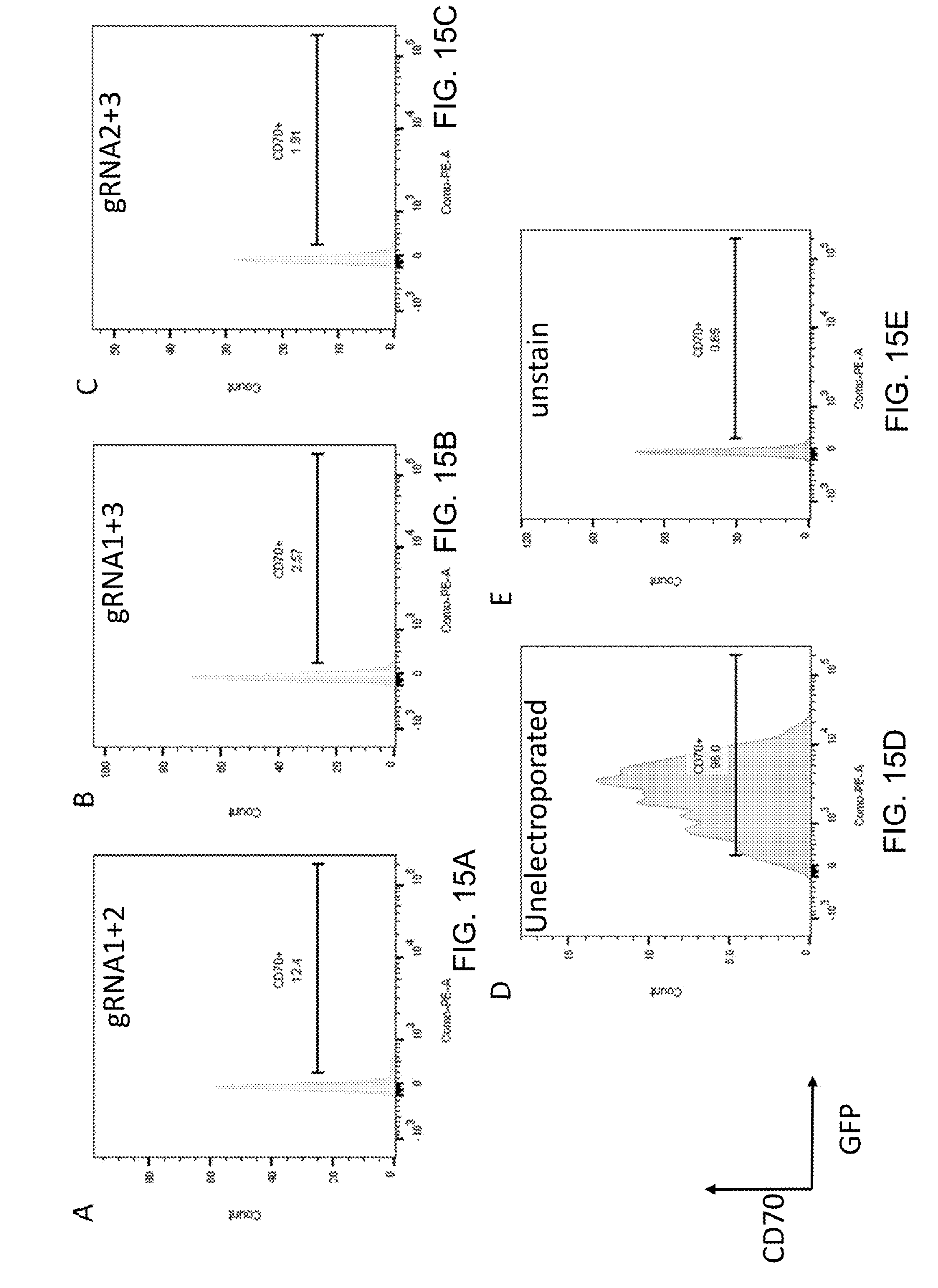
FIGS. 15A-15E show flow cytometry data related to CD70 expression 14 days after CRISPR-mediated CD70 knockout (21 days total), with the NK cells from the same donor as in FIGS. 12-14, but using combinations of guide RNA.

FIGS. 15A-15E show FACS analysis data for NK cells where double guide RNAs where used to target CD70. FIGS. 15D and 15E repeat the control data of 14D/14E. FIG. 15A shows guide RNAs 1 and 2, which resulted in almost 80% knockdown of CD70 expression. FIG. 15B shows guide RNAs 1 and 3, which resulted in almost 97% knockdown of CD70 expression. FIG. 15C shows guide RNAs 2 and 3, which resulted in over 98% knockdown of CD70 expression. These data demonstrate that in some embodiments, use of a single guide RNA to edit a gene results in substantial decreases in expression of a target protein. However, in several embodiments, use of a plurality of guide RNAs to edit a gene can further reduce the expression of a target protein.

Figures 16A, 16B:
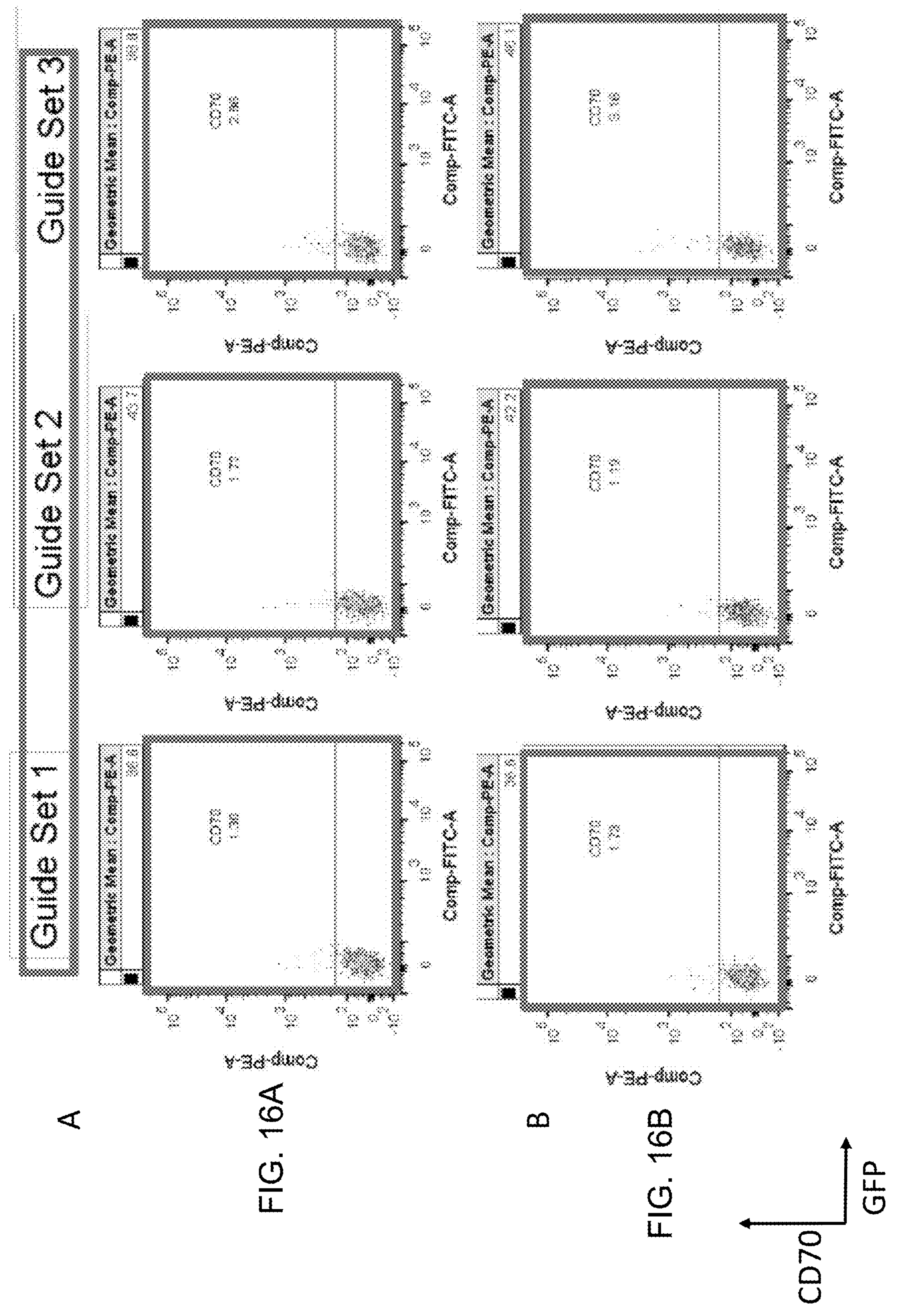
FIGS. 16A-16C show flow cytometry data related to knockdown of CD70 expression in two different donors. For these experiments, CRISPR-mediated CD70 knockout was performed prior to NK cell expansion, using the KD0 protocol, with the data shown from Day 5 post-electroporation.
Figure 16C:
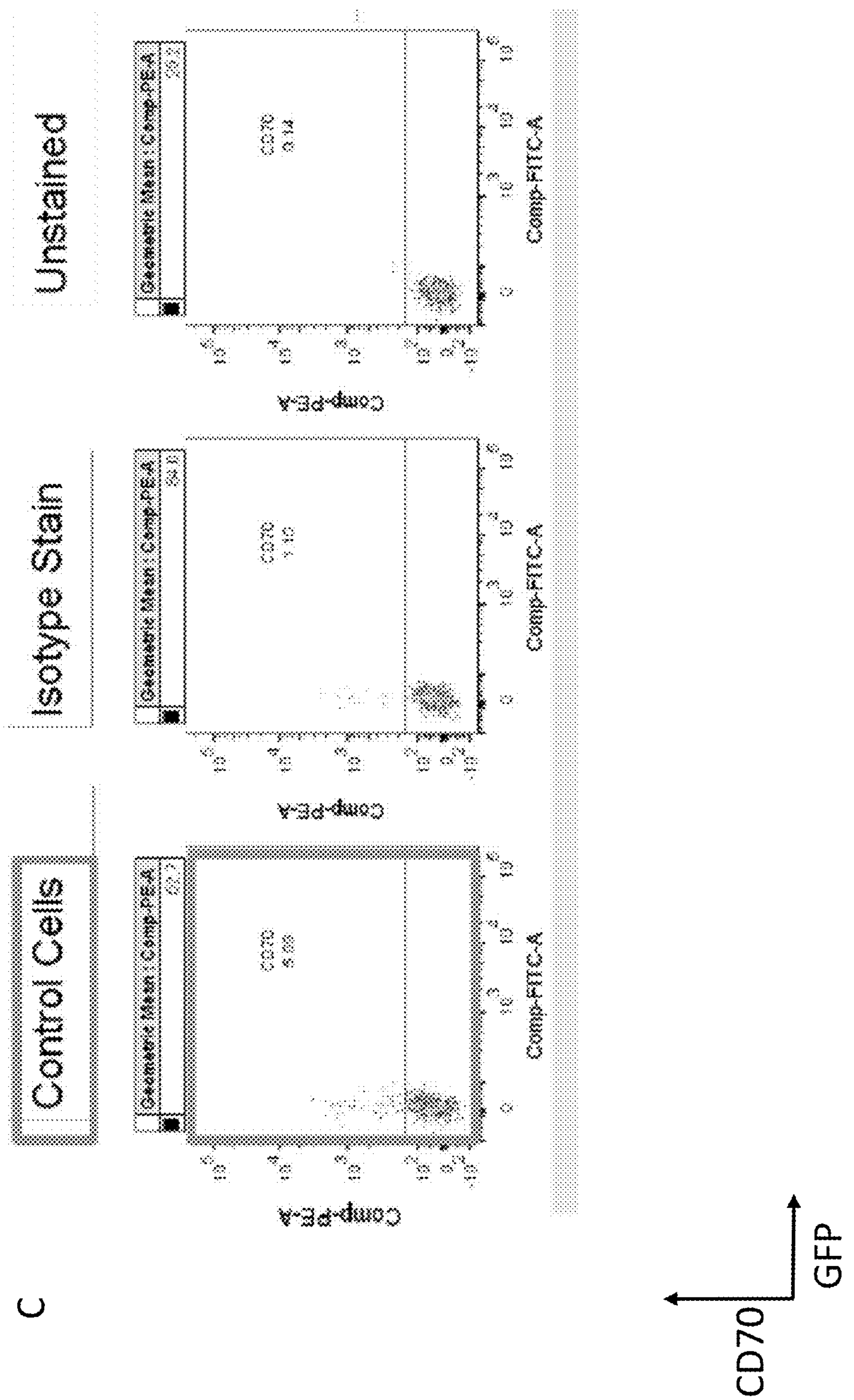
Figure 17C:
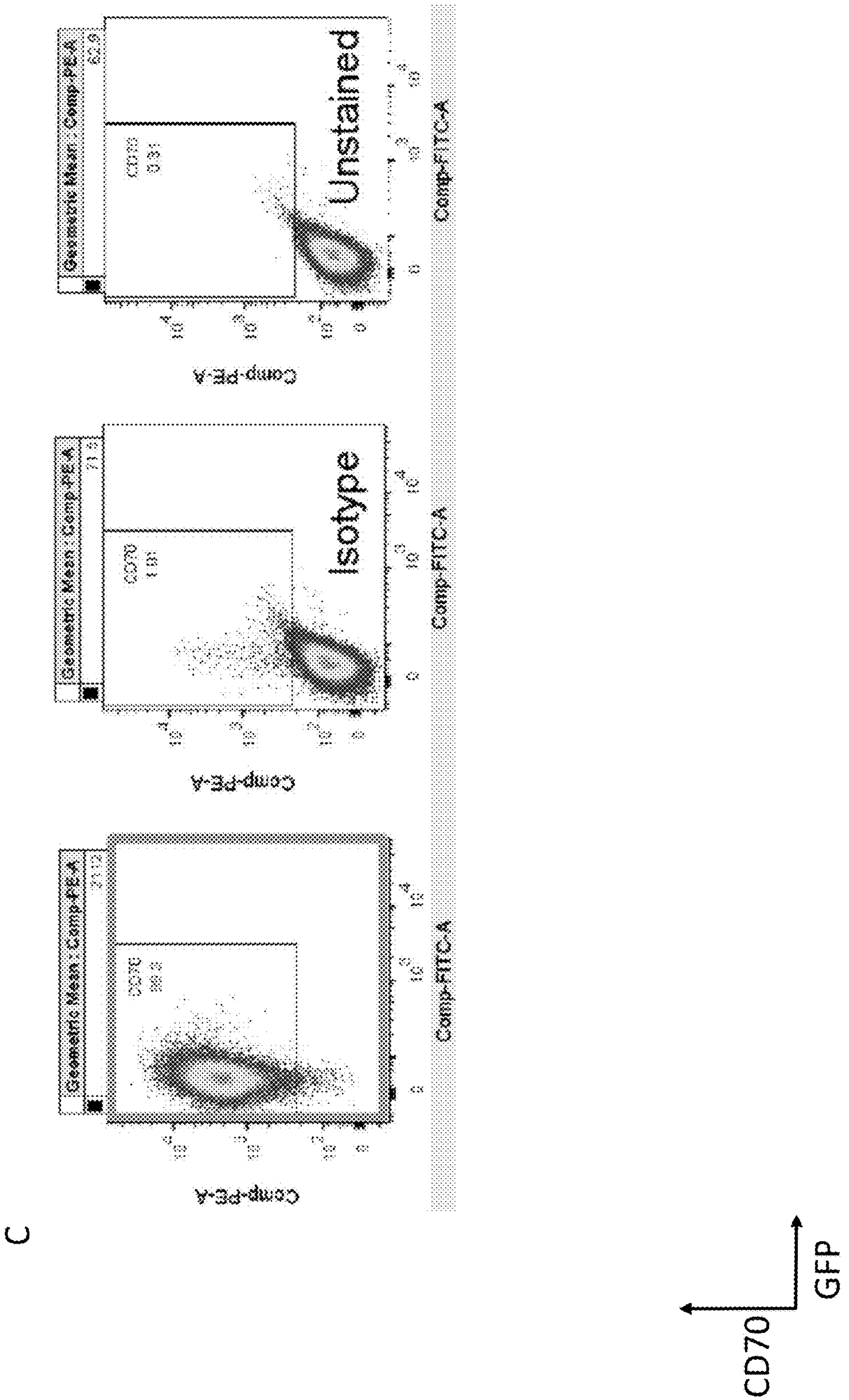

FIGS. 16A-16C show additional gene editing (here using the KD0 approach) on NK cells from two different donors, in order to further assess the effects of gene editing prior to expansion. FIG. 16A shows the knockdown of CD70 expression on NK cells from a first donor using three different guide RNAs (CD70-1, CD70-2, CD70-3, see Table 1). FIG. 16B shows results for NK cells of a second donor, while FIG. 16C shows control data (native, unexpanded NK cells, which express low levels of CD70). As can be seen from these data, as in accordance with several embodiments substantially all native CD70 expression was knocked out using various guide sets. At Day 5 post expansion, guide set 1, 2, and 3, reduced expressing of native CD70 by almost 99%, 98%, and 97%, respectively for a first donor (16A). Those guide RNAs achieved almost 98%, 99% and 97% (respectively) reduction of CD70 expression on NK cells of a second donor (16B). CD70 expression was assessed at Day 13 post-editing (8 days after the first assessment of CD70 expression. Of note is that the NK cells robustly expanded, in spite of the CD70 knockout, indicating that expansion of NK cells to clinically relevant numbers is possible, even with genetic editing. FIG. 17A shows the CD70 expression for a first donor, which even after an additional 8 days in culture, was still significantly reduced using guide set 1 and guide set 2 (approximately 70-80% using those gRNAs). The "recovery" of expression of CD70 is due to the expansion of NK cells in which CD70 was not knocked out or was only partially knocked down. The maintenance of CD70 expression at about 70-80% still represents a significant portion of the NK cell population that could avoid the cytotoxic effects of other NK cells expressing an anti-CD70 CAR. CD70 expression was higher (e.g., recovered) using guide set 3. Similar results are shown for a second Donor (FIG. 17B), again with guide RNA set 1 and 2 maintaining over 80% CD70 knockout. FIG. 17C shows control data. In several embodiments, sequential rounds of CD70 FACS can be used to obtain an NK cell population that is over about 95%, about 96%, about 97%, about 98%, about 99% or more, CD70 negative. In several embodiments, FACS can be followed by further expansion of this screened NK cell population to further increase NK cell number, and additional FACS screening could optionally be performed to further purify that expanded population.

Figure 18A:
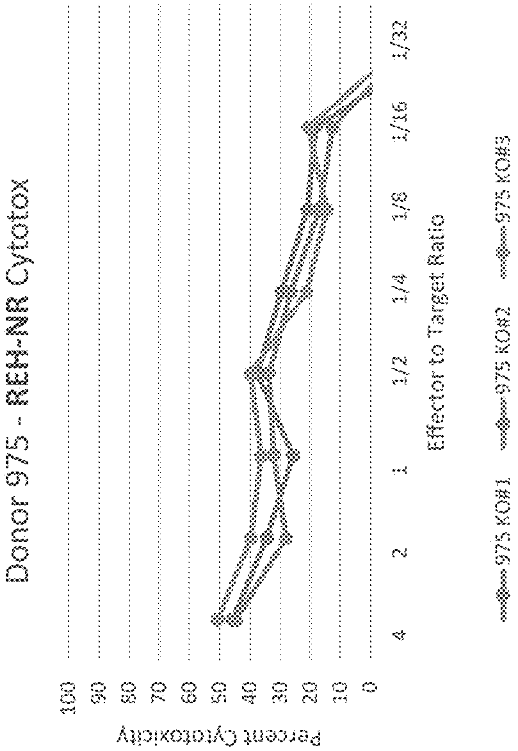
FIGS. 18A-18D show data related to the cytotoxicity to CD70 knockout NK cells (CD70-KO-NK) from two donors.
Figure 18B:
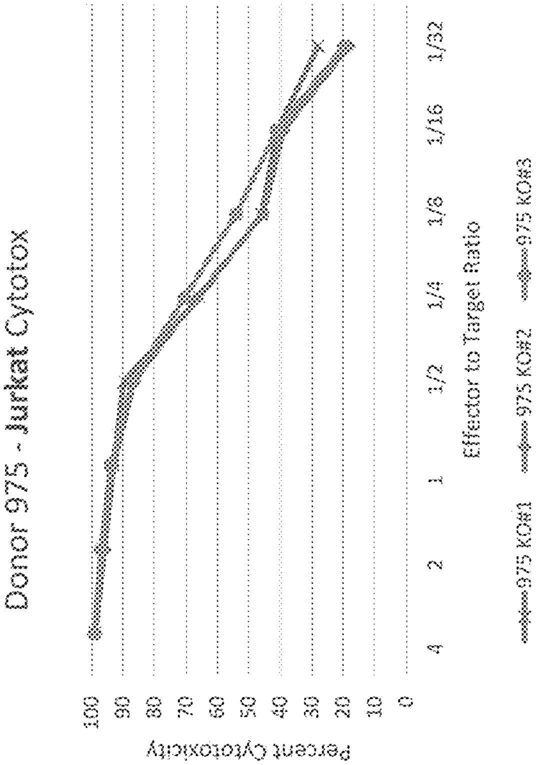
Figure 18C:
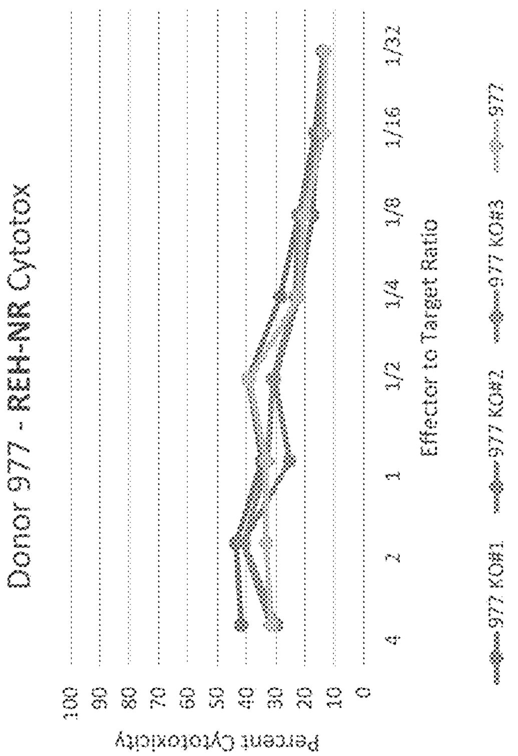
Figure 18D:
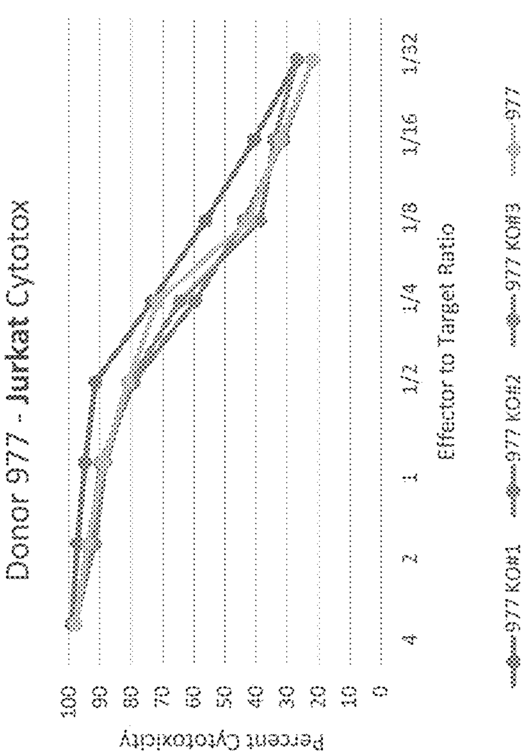

Having shown that NK cells can be edited and expanded, experiments were performed to assess the ability of those cells to exert cytotoxic effects on target cells. Jurkat cells express CD27, which is the ligand for CD70. In contrast, Reh cells do not express CD27. FIGS. 18A-D show cytotoxicity data against either Jurkat or Reh cells at the indicated effector:target ratios, the experiment performed at Day 14 post-electroporation. FIGS. 18A and 18B are data from NK cells of a first donor, while 18C/18D are cells from a different donor. Notably, whether the target cells express the CD70 ligand, CD27, or not, NK cells can exert cytotoxic effects. The reduction of the E:T ratio (which effectively dilutes out the edited NK cells) yields an expected decrease in the overall cytotoxicity measured. Thus, as is in accordance with several embodiments disclosed herein, the relative cytotoxicity of an NK cell edited to reduce its native CD70 expression is retained against a given cell line. FIGS. 18A-18D also demonstrate that there are alternative mechanisms by which NK cells exert their cytotoxicity other than through a CD70-CD27 interaction. This is shown by virtue of the fact that CD70-negative NK cells can still retain cytotoxicity against Jurkat cells (which express the CD70 ligand, CD27), and can also exert cytotoxicity against Reh cells, which do not express CD27.

Figures 19A, 19B:
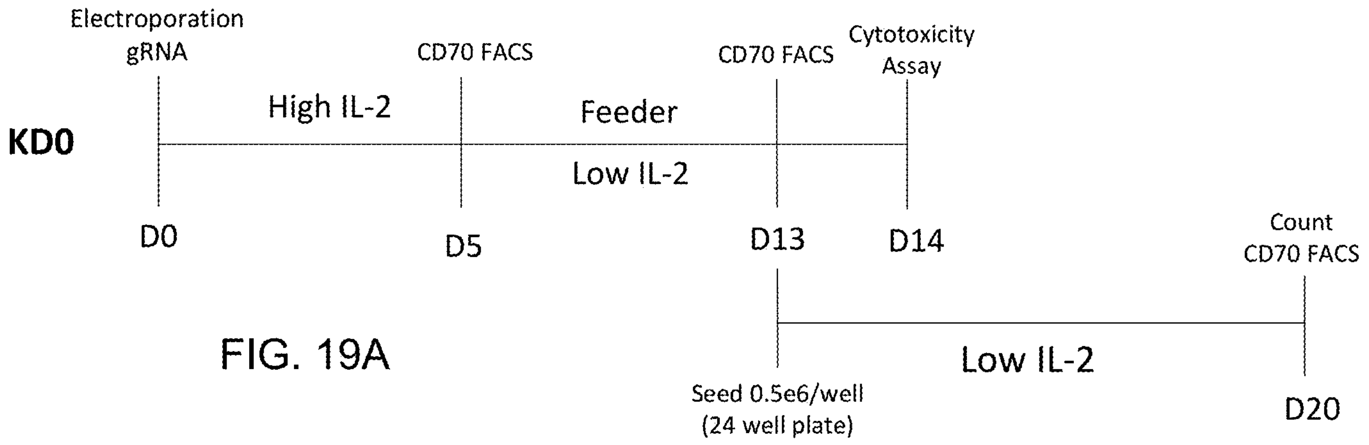
FIGS. 19A-19B relate to a schematic timeline for a protocol to genetically engineer and expand NK cells and data related to NK cell expansion.
Figures 20A, 20B:
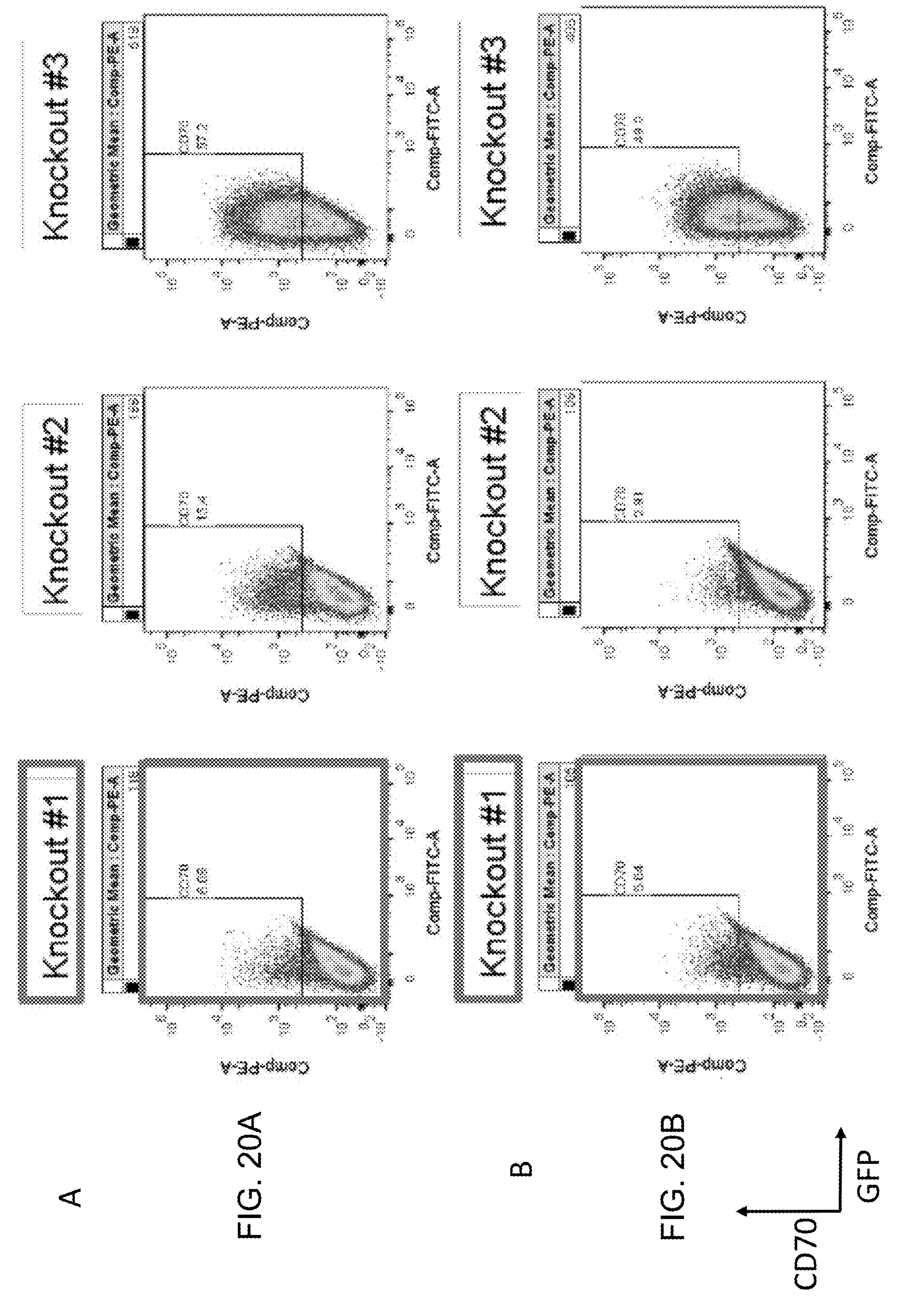
FIGS. 20A-20C show flow cytometry data after CRISPR gene editing of NK cells.
Figure 20C:
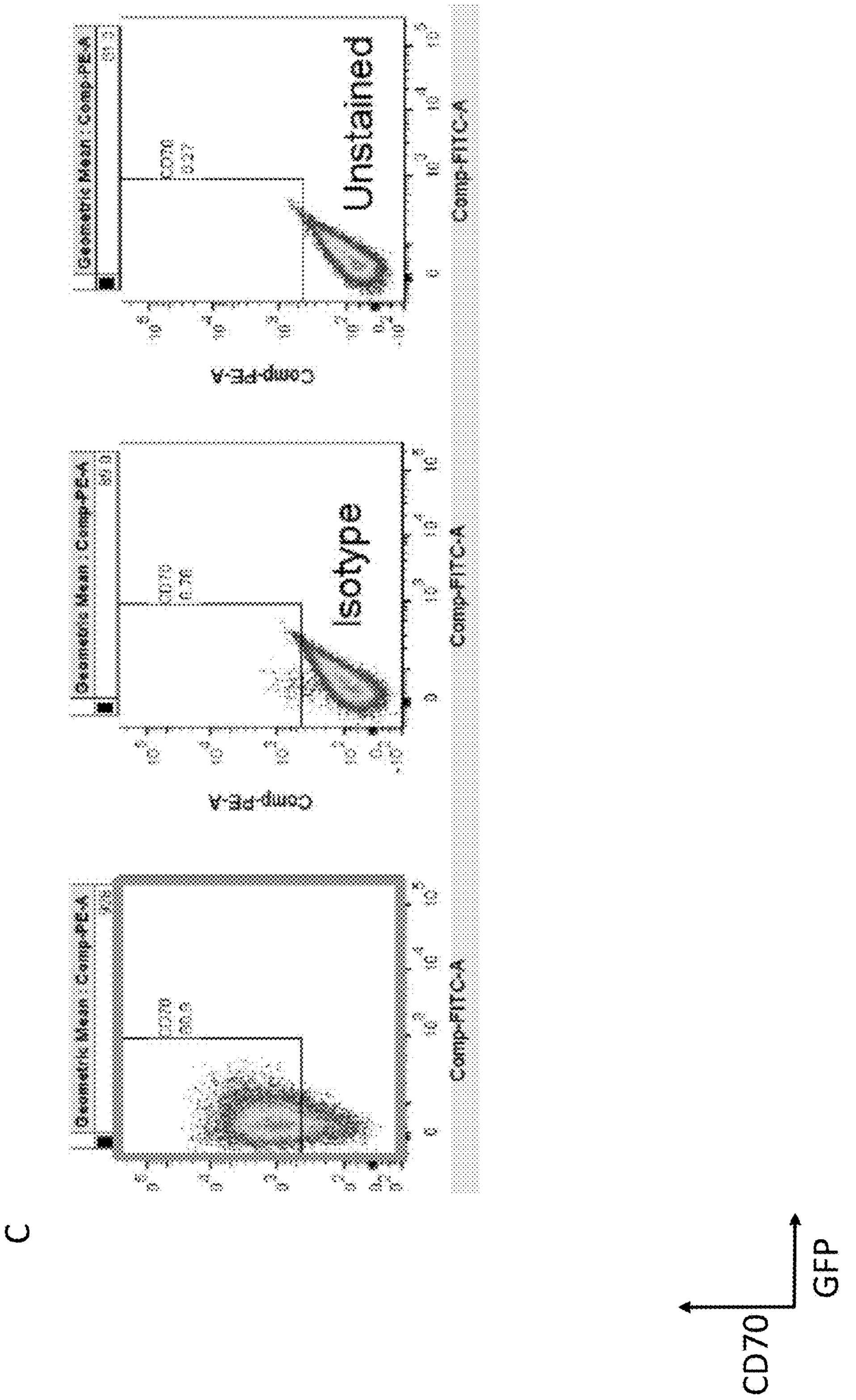

Experiments were also conducted to revisit the degree of impact, if any, of CD70 deletion on NK cell expansion. FIG. 19A shows a schematic of a KD0 gene editing protocol (as was used to generate the cells tested in FIGS. 18A-18D. However, at Day 13, a fraction of the cells were seeded at a relatively low density ($0.5\times10^6$ cells/well) in 24 well plates and expanded for an additional 7 days in low IL-2 media. Cell counts were performed by FACS at Day 20. Expansion data are summarized in FIG. 19B. Cells from the two donors mapped out by guide RNAs used in each row show reasonably consistent viability across the experimental sample, most samples being in the mid- to high-70's in terms of percent viable cells. Fold growth of the cells is shown in a box in FIG. 19B. These data demonstrate that experimental NK cells show between about 1.7 to about 2.5-fold growth over 20 days, even when CD70 expression is disrupted. FACS analysis of the expression levels of CD70 on NK cells at day 20 was performed and those data are shown in FIGS. 20A-20C. FIG. 20A shows CD70 expression for the first donor using the three knockout guides, and FIG. 20B shows the data for the second donor. FIG. 20C shows unedited NK cells and other relevant controls. The initial CD70 percentage expression, expression at Day 7 (the data discussed in FIGS. 16A-16B), and final CD70 expression is tabulated here. Knockout 1 and Knockout 2 maintained less than about 7% expression across those four samples, with Knockout 2 showing less than 3% of the NK cells expressing CD70 at the final Day 20 time point. Interestingly, Knockout 1 and Knockout 2, exhibited the two lowest CD70 expression levels, but also some of the highest fold-expansion values. Thus, as is in accordance with several embodiments disclosed herein, knockdown or knockout of native CD70 expression on NK cells (or T cells), does not impair the ability of the NK (or T) cells to expand in culture.

Example 2—CD70 Knockout, CD70 Expression and Functionality of Jurkat Cells

As discussed in more detail below, several embodiments provided for herein relate to NK cells edited to reduce, substantially reduce, or eliminate native CD70 expression by the NK cells in conjunction with engineering the NK cells to express an anti-CD70 CAR. The gene editing reduces the suicide effect of the CAR-expressing engineered cells. In order to evaluate the ability of a give CAR to bind CD70, a control cell line was developed through gene editing to achieve high (e.g., at least about 100,000, at least about 150,000, at least about 200,000, at least about 250,000, or more, copies of CD70 per cell) CD70 expression. As mentioned above, Jurkat cells express relatively high levels of CD70, however, to mimic tumor-like CD70 expression, native CD70 expression was first knocked out with gene editing, then replaced achieve the desired copy numbers discussed above.

Figures 21A, 21B:
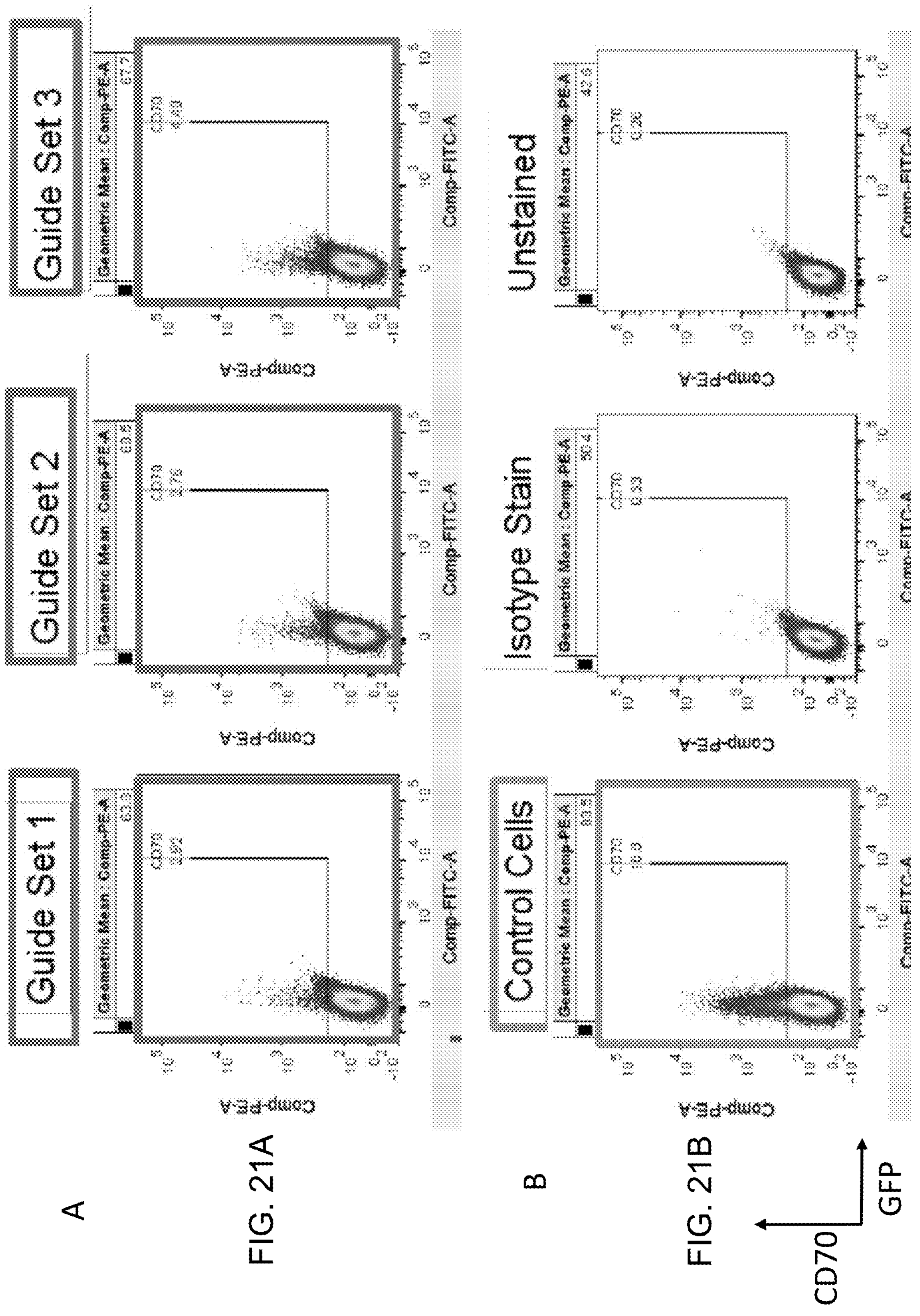
FIGS. 21A-21B show flow cytometry data after CRISPR gene editing of Jurkat cells.
Figure 22A:
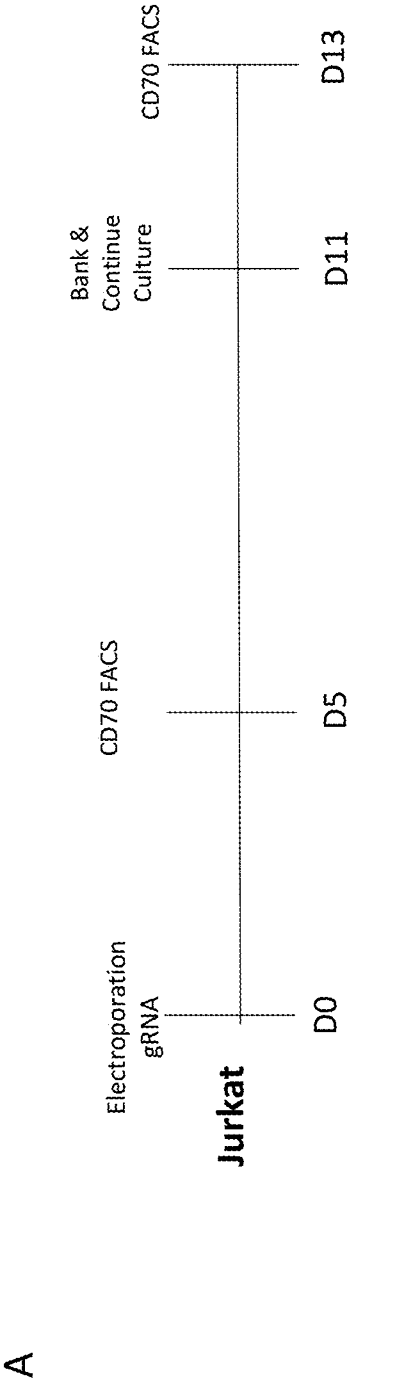
FIGS. 22A-22D show flow cytometry data after CRISPR gene editing of Jurkat cells.
Figure 22B:
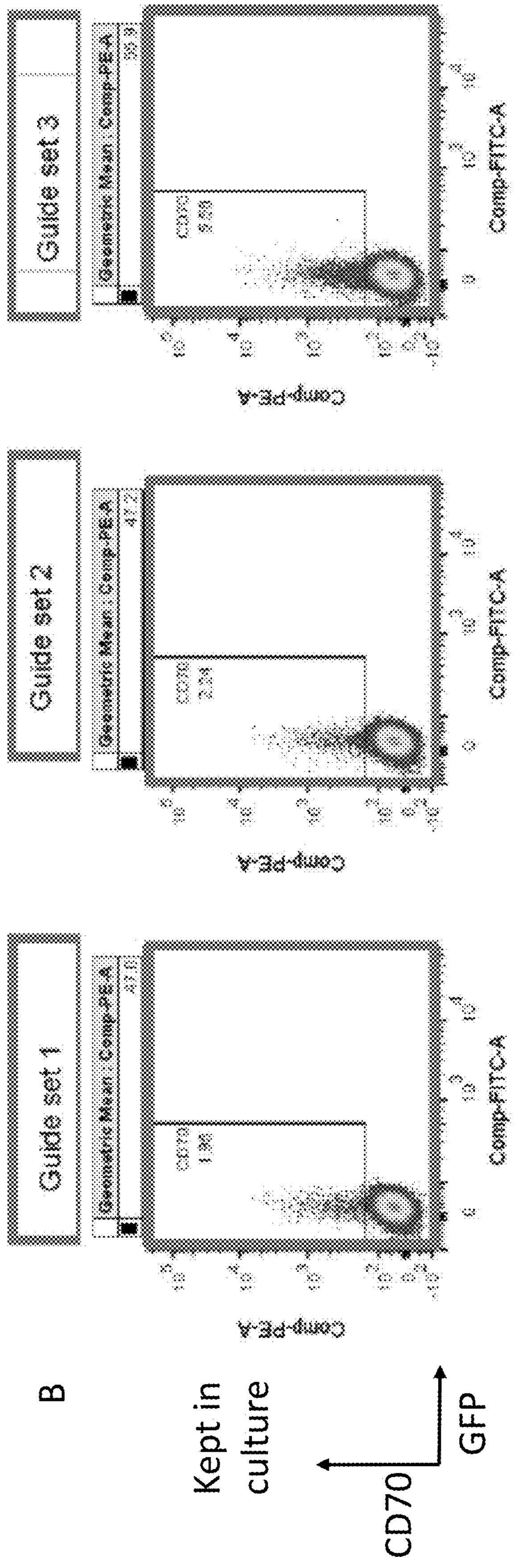
Figures 22C, 22D:
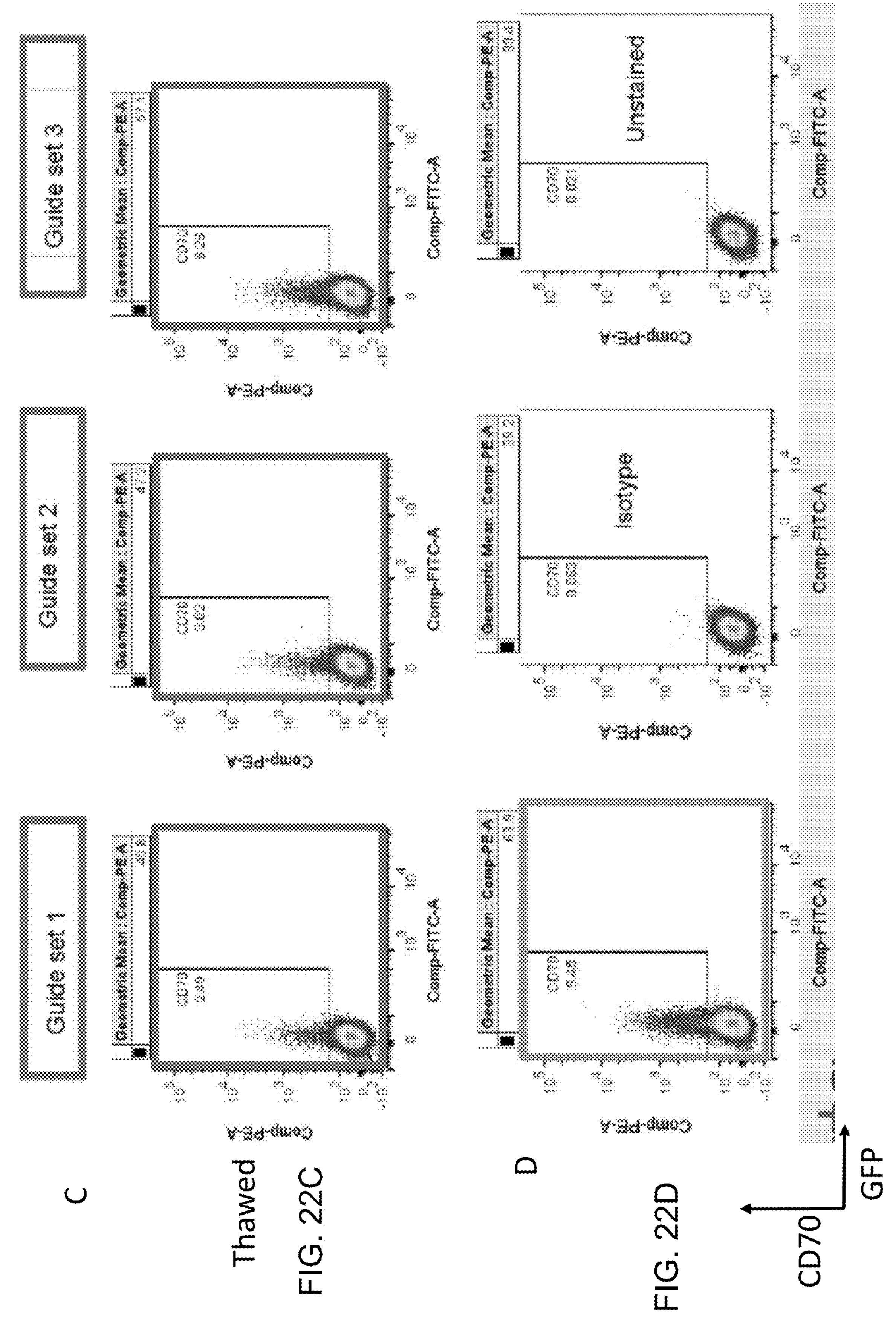

FIGS. 21A and 21B relate to CD70 knockout on Jurkat cells. FIG. 21A shows that each of guide RNA set 1, set 2, and set 3, reduce Jurkat CD70 expression by at least 96%. FIG. 21B shows control data. FIG. 22A shows a schematic time frame for knockout, expansion or storage of cells and analysis of CD70 expression. FIG. 22B shows data for CD70 expression after use of guide RNA set 1, 2, or 3, where the Jurkat cells were maintained in culture for the duration of the experiment, until CD70 FACS at Day 13. In these data, each of the guide RNA sets reduced expression by over 94%, with guide RNA set 2 reducing expression by over 97% and guide RNA set 1 by over 98%. FIG. 22C shows data for Jurkat cells that were expanded in the same manner as the cells in 22B, until day 11, at which time they were frozen. At Day 13, those cells were thawed and CD70 expression was assessed. As shown in FIG. 23C, the freeze/thaw cycle, which can often disrupt gene expression and/or viability of cells, did not appear to substantially alter the efficacy of the CD70 knockdown. This suggests that, according to several embodiments disclosed herein, Jurkat cells can be edited to reduce CD70 expression, then expanded and stored (e.g., frozen), with the storage period and the subsequent thaw cycle not adversely impacting the CD70 expression reduction. FIG. 22D shows relevant control data.

Figure 23:
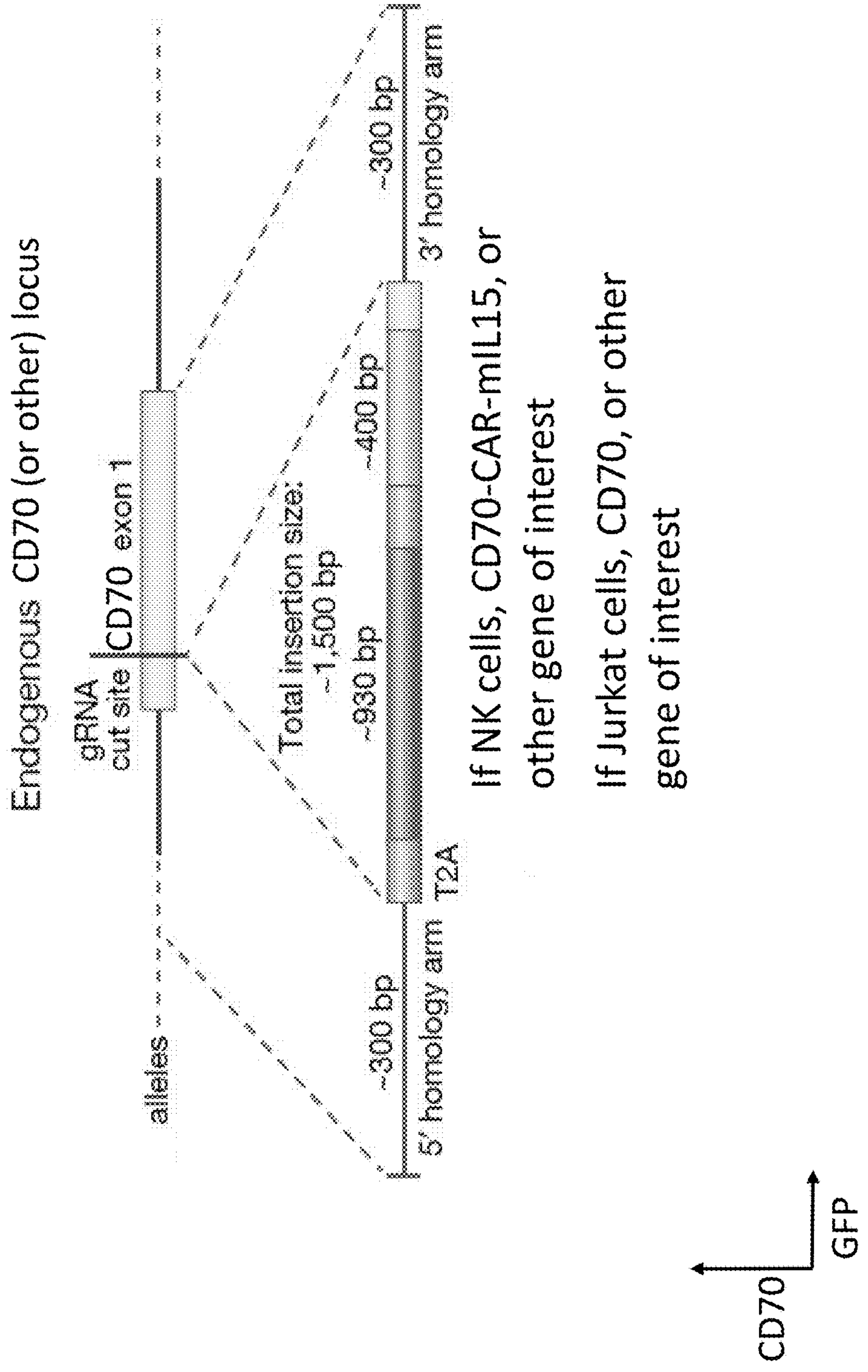
FIG. 23 shows a schematic for a non-limiting embodiment of a gene editing construct for CRISPR modification (knock-in) of the endogenous CD70 locus in NK cells to insert a CD70-directed CAR construct into the endogenous locus.

FIG. 23 shows a non-limiting schematic of a knock-in approach used to introduce expression of a gene or other desired construct into a particular location, ultimately for expression of that gene by the host cell. For example, in some embodiments, the host cell is an NK cell and the target locus is the endogenous CD70 locus. By directing a targeted insertion at that point, in some embodiments, the native CD70 expression is eliminated, and a CD70-targeting CAR could be inserted. Alternatively, the target locus could be CD70 and another gene of interest could be knocked in at that point. In still additional embodiments, for example with generation of high-CD70 Jurkat cells, the endogenous locus of CD70 could be targeted/interrupted, and an enhanced CD70 could be inserted (e.g., driven by an enhanced promoter, etc. to enhance CD70 expression to a desired level) and/or perhaps including a marker, such as GFP, to enable visualization of the edited cells.

Figures 24A, 24B:
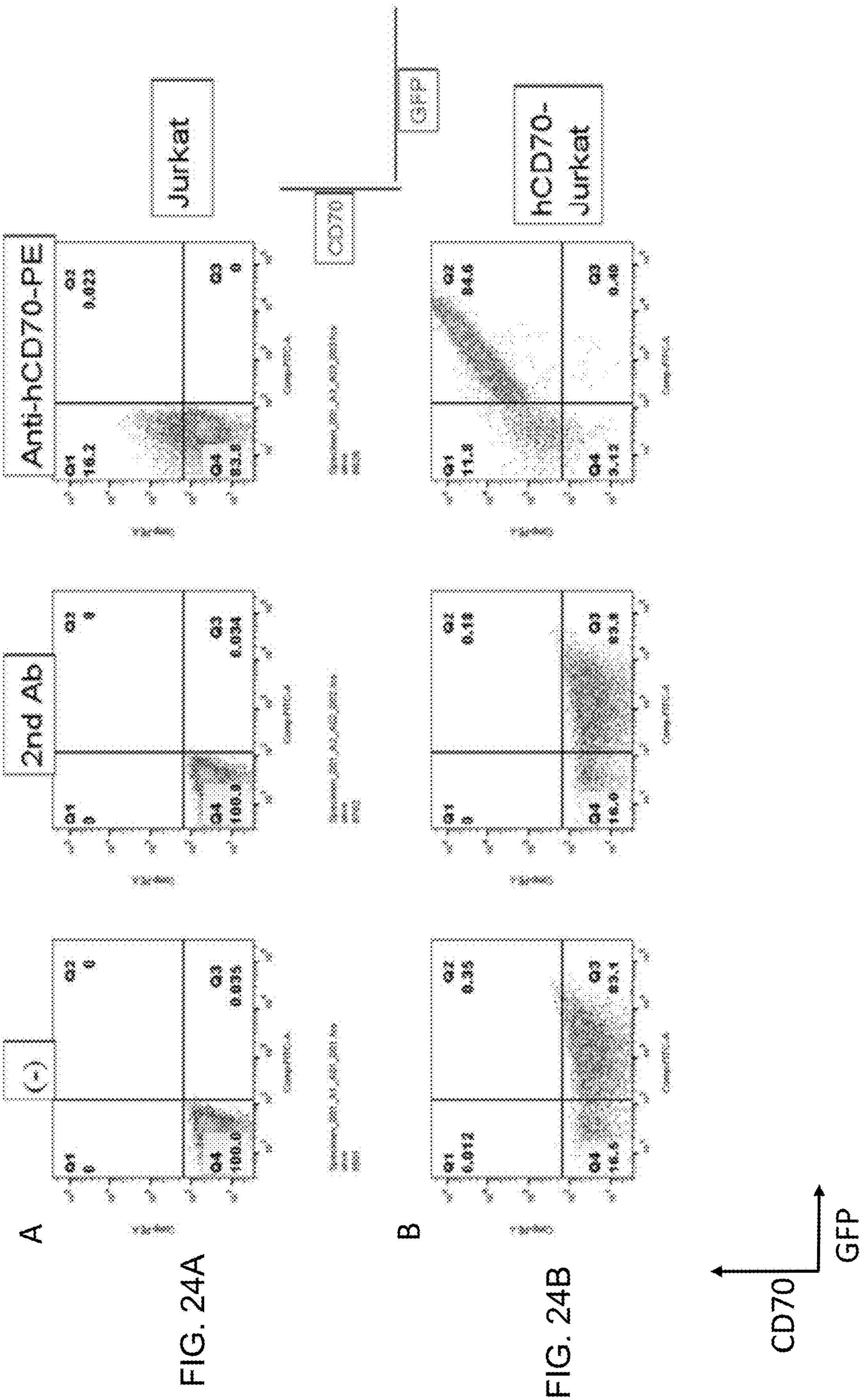
FIGS. 24A-24F relate to data assessing the engineered expression of CD70 on Jurkat cells and on Jurkat cells subjected to CRISPR gene editing. The left panel of each of the figures is a negative control, and the central panel a control using only the secondary antibody.
Figures 24C, 24D:
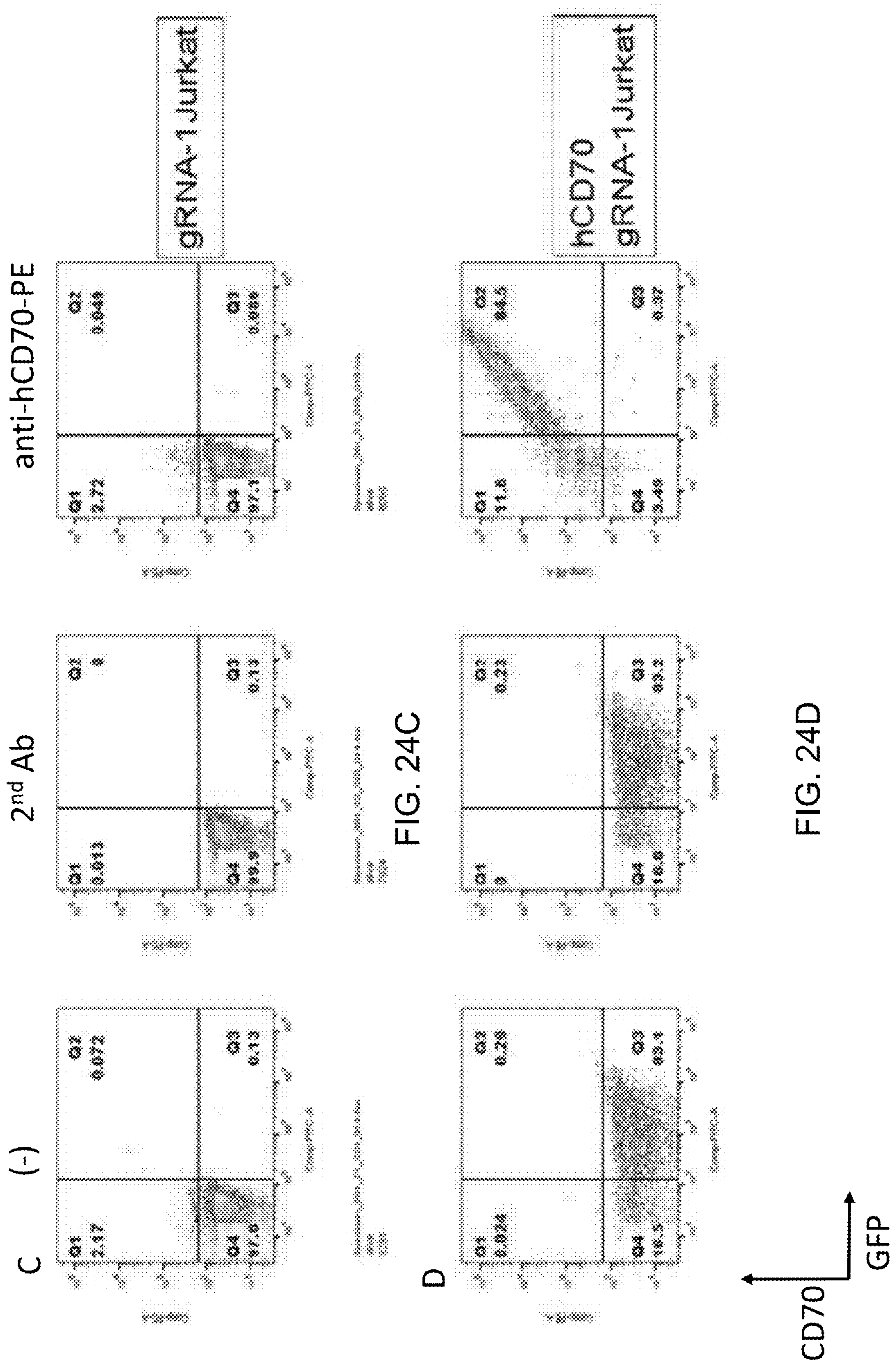
Figures 24E, 24F:
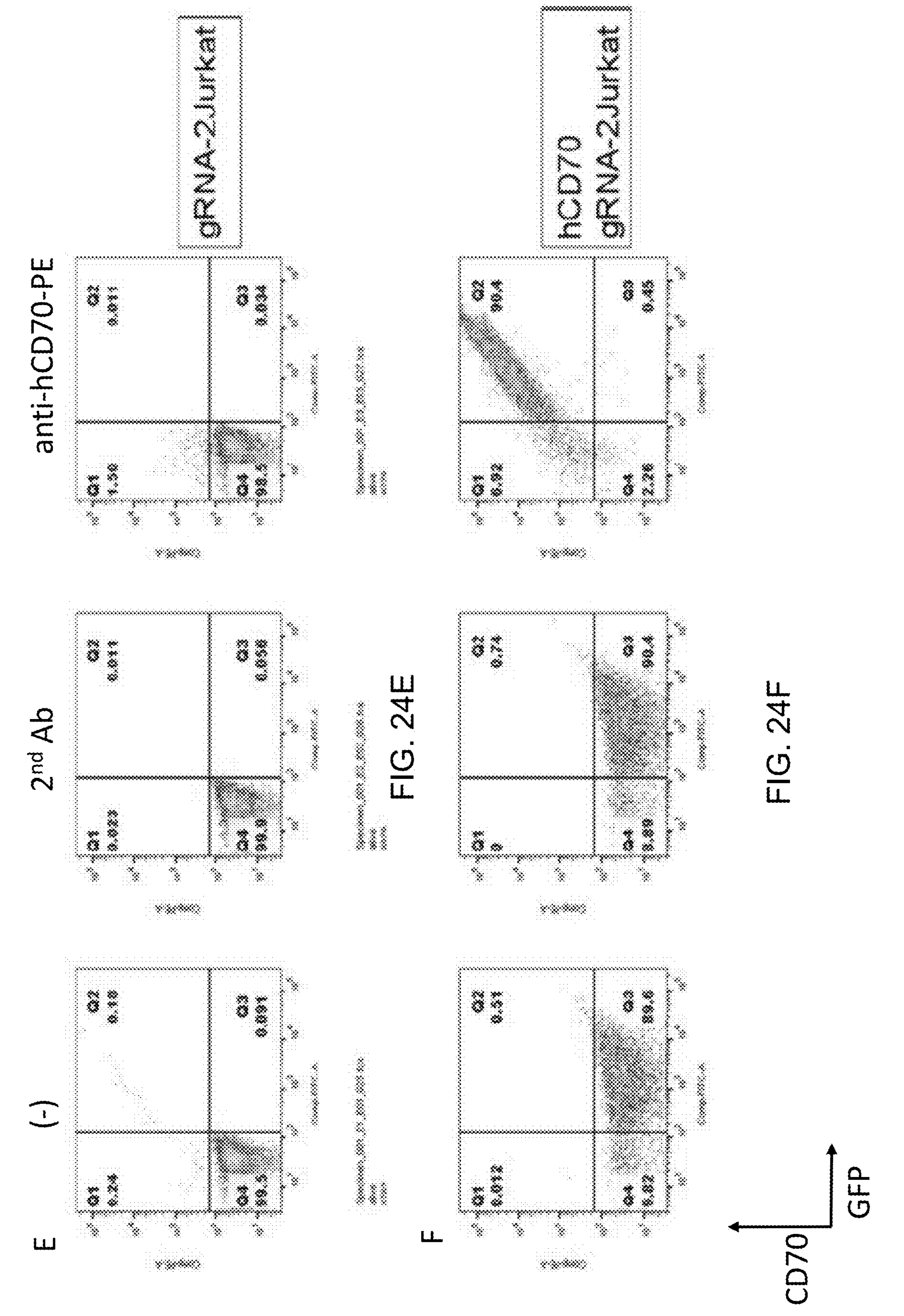

Continuing the development of a high-CD70 expressing Jurkat cells for screening of CD70 CARS, a viral construct was generated encoding human CD70 tagged with GFP (hCD70) and used to transduce either wild-type Jurkat cells or Jurkat cells previously subjected to CD70 knockdown by guide RNA set 1 or guide RNA set 2. FIG. 24A shows (left to right) non-stained wild-type Jurkat cells, a secondary antibody control, and expression of the human CD70-GFP construct (which is essentially zero, as these are wild-type cells). FIG. 24B shows (left to right) the same data as discussed above but with Jurkat cells that are transduced with the human CD70-GFP construct. Here, nearly 85% of the cells express the delivered construct. FIG. 24C shows the corresponding data for Jurkat cells edited using guide RNA set 1. The right-most panel shows that nearly 97% of the CD70 expression has been eliminated. FIG. 24D shows Jurkat cells edited with guide RNA set 1 and transduced with the human CD70-GFP construct. Nearly 85% of the edited and transduced Jurkat cells express the detectable human CD70-GFP construct. FIG. 24E shows corresponding data for editing of Jurkat cells with guide RNA set 2, which resulted in over 98% reduction of CD70 expression. FIG. 24F shows "replacement" expression of human CD70-GFP through the viral transduction which results in over 90% of the Jurkat cells expression hCD70-GFP. These data are summarized in FIG. 25, with two different gating scenarios used to view the data in multiple ways. The MFI represents expression of human CDCD70-GFP by the indicated cells. 786-O cells are provided as a reference, as they are renal cell carcinoma cells, which is a tumor type known to highly express CD70. Notably, direct viral transduction of Jurkat cells with the human CD70-GFP construct results in robust hCD70-GFP expression, as does the reduction of endogenous CD70 expression with guide RNA set 1 or 2. However, when data is gated on the population of Jurkat cells that were transduced to a great level (rather than the entire Jurkat population), the expression of hCD70-GFP exceeds the CD70 expression of the 786-O RCC cells. This demonstrates that, according to several embodiments, an edited and engineered Jurkat cell line can be generated that is useful for the screening of anti-CD70-targeting CARs.

Jurkat cells were also subject to viral transduction with human anti-CD70 antibodies, shown as a non-limiting embodiment in FIGS. 26B and 26C as "NK71 scFv" and "NK72 scFv" (SEQ ID NO: 36 and SEQ ID NO: 37, respectively). Each of these antibodies has a flag tag (though according to some embodiments, none of the antibodies used in CAR constructs comprise a flag tag or any other tag). FIG. 26A shows control data. FIG. 26B shows expression of the NK71 antibody on the Jurkat cells and FIG. 26C shows expression of the NK72 antibody, which is elevated over the expression of the NK71 antibody.

FIGS. 27A-27F show data related to the determination of whether the NK71 or NK72 expressing Jurkat cells can bind human CD70. FIG. 27A shows (left to right) a negative control, an isotype control (hFC-APC) and Jurkat cell binding to CD70 (using a DNA sequence encoding the extracellular domain of human CD70 (NP_001243.1) (Gln 39-Pro 193) fused with the Fc region of human IgG1 at the N-terminus via a polypeptide linker) when added at two different concentrations (2 ug/ml) or (10 ug/ml). FIG. 27B shows (left to right) control binding when Jurkat cells are exposed to a murine Fc-directed antibody, binding of murine CD70 by the Jurkat cells (again at two concentrations) and the degree of NK71/NK72 expression by an APC-tagged anti-flag antibody. These data show that Jurkat cells, which have endogenous CD27 expression (the ligand for CD70) bind to human CD70, but less so to murine CD70. FIGS. 27C and 27D show corresponding data for Jurkat cells transduced with the NK71 antibody. Exposure of the Jurkat cells to 2 ug/mL of CD70 resulted in almost 50% of the Jurkat cells binding the CD70, whereas use of 10 ug/mL elevated that binding to over 80%. Similar patterns are seen with murine CD70 (27D), with the overall binding being less robust. The right-most panel of FIG. 27D shows that the binding data was achieved with just about 16% of the Jurkat cells expressing the NK71 antibody. FIGS. 27E and 27F show corresponding data for Jurkat cells transduced to express NK72. FIG. 27E shows (left to right, a negative control, isotype antibody control and significant binding of CD70 by the Jurkat cells at both 2 and 10 ug/mL, with the latter showing that nearly 97% of the Jurkat cells binding CD70. FIG. 27F shows corresponding data for murine CD70, and (right-most) that NK72 expression was quite robust, with nearly 83% of Jurkat expressing the NK72 antibody. Collectively, these data demonstrate that a target gene of interest can be knocked out efficiently through, according to several embodiments a combination of guide RNAs and that, also according to several embodiments cells can be engineered to express an antibody that binds to a target of interest. In several embodiments, such cells are beneficial for, for example, screening candidate binding moieties for one or more desired characteristics, e.g., affinity for target.

Example 3—Editing of Multiple Genes and Engineering NK Cells with an Anti-CD70 CAR As discussed above, in several embodiments, immune cells (e.g., NK cells) are edited, for example to knock down or knock expression of a target gene. In some embodiments, multiple genes are edited. In several embodiments, in addition to editing one or more target genes, immune cells (e.g., NK cells) are engineered to express a chimeric antigen receptor that targets one (or more) target antigens, such as a tumor marker. In several embodiments, immune cells, such as NK cells are edited to reduce, substantially reduce, and/or eliminate CD70 expression and engineered to express a CAR that targets CD70. In several embodiments, the immune cells are optionally also edited to reduce, substantially reduce, and/or eliminate CISH expression. In several embodiments, the immune cells are optionally also edited to reduce, substantially reduce, and/or eliminate TGFBR (e.g., TGFBR2) expression. In several embodiments, the immune cells are optionally also edited to reduce, substantially reduce, and/or eliminate NKG2A expression. In several embodiments, the immune cells are optionally also edited to reduce, substantially reduce, and/or eliminate ADORA2A (Adenosine 2a Receptor) expression. In several embodiments, the immune cells are optionally also edited to reduce, substantially reduce, and/or eliminate Cytokine Signaling 2 (SOCS2) expression. In several embodiments, the immune cells are optionally also edited to reduce, substantially reduce, and/or eliminate Casitas B-lineage lymphoma-b (Cbl-b) expression. In several embodiments, the immune cells are optionally also edited to reduce, substantially reduce, and/or eliminate Beta-2 Microglobulin (B2-microglobulin, or B2M) expression. In several embodiments, the immune cells are optionally also edited to reduce, substantially reduce, and/or eliminate T cell immunoreceptor with Ig and ITIM domains (TIGIT) expression. In several embodiments, the immune cells are optionally also edited to reduce, substantially reduce, and/or eliminate Programmed cell death protein-1 (PD-1) expression. In several embodiments, the immune cells are optionally also edited to reduce, substantially reduce, and/or eliminate T-cell immunoglobulin and mucin-domain containing-3 (TIM-3) expression. In several embodiments, the immune cells are optionally also edited to reduce, substantially reduce, and/or eliminate CD38 expression. In several embodiments, the immune cells are optionally also edited to reduce, substantially reduce, and/or eliminate T cell receptor alpha (TCR $\alpha$) expression. In several embodiments, the immune cells are optionally also edited to reduce, substantially reduce, and/or eliminate CEACAM1 expression. In several embodiments, the immune cells are optionally also edited to reduce, substantially reduce, and/or eliminate DDIT4 expression. In several embodiments, the immune cells are optionally also edited to reduce, substantially reduce, and/or eliminate MAPKAP Kinase 3 (MAPKAPK3) expression. In several embodiments, the immune cells are optionally also edited to reduce, substantially reduce, and/or eliminate SMAD3 expression.

Non-limiting examples of guide RNAs to edit one or more of such targets (e.g., using Cas9, CasX, CasY or other endonuclease) may be found in U.S. Provisional Patent Application No. 63/201,159, filed Apr. 15, 2021, the entire contents of which is incorporated by reference herein.

The tumor microenvironment (TME), as suggested with the nomenclature, is the environment around a tumor, which includes the surrounding blood vessels and capillaries, immune cells circulating through or retained in the area, fibroblasts, various signaling molecules related by the tumor cells, the immune cells or other cells in the area, as well as the surrounding extracellular matrix. Various mechanisms are employed by tumors to evade detection and/or destruction by host immune cells, including modification of the TME. Tumors may alter the TME by releasing extracellular signals, promoting tumor angiogenesis or even inducing immune tolerance, in part by limiting immune cell entry in the TME and/or limiting reproduction/expansion of immune cells in the TME. The tumor can also modify the ECM, which can allow pathways to develop for tumor extravasation to new sites. Transforming Growth-Factor beta (TGFb) has beneficial effects when reducing inflammation and preventing autoimmunity. However, it can also function to inhibit anti-tumor immune responses, and thus, upregulated expression of TGFb has been implicated in tumor progression and metastasis. TGFb signaling can inhibit the cytotoxic function of NK cells by interacting with the TGFb receptor expressed by NK cells, for example the TGFb receptor isoform II (TGFBR2). In accordance with several embodiments disclosed herein, the reduction or elimination of expression of TGFBR2 through gene editing (e.g., by CRISPR/Cas9 guided by a TGFBR2 guide RNA) interrupts the inhibitory effect of TGFb on NK cells.

As discussed above, the CRISPR/Cas9 system was used to specifically target and reduce the expression of the TGFBR2 by NK cells. Various non-limiting examples of guide RNAs were tested, which are summarized below.

TABLE 2

TGFb Receptor Type 2 Isoform Guide RNAs

| SEQ ID NO: | Name | Sequence |
|---|---|---|
| 124 | TGFBR2-1 | CCCCTACCATGACTTTATTC |
| 125 | TGFBR2-2 | ATTGCACTCATCAGAGCTAC |
| 126 | TGFBR2-3 | AGTCATGGTAGGGGAGCTTG |
| 127 | TGFBR2-4 | TGCTGGCGATACGCGTCCAC |
| 128 | TGFBR2-5 | GTGAGCAATCCCCCGGGCGA |
| 129 | TGFBR2-6 | AACGTGCGGTGGGATCGTGC |

In accordance with additional embodiments, a disruption of, or elimination of, expression of a receptor, pathway or protein on an immune cell can result in the enhanced activity (e.g., cytotoxicity, persistence, etc.) of the immune cell against a target cancer cell. In several embodiments, this results from a disinhibition of the immune cell. Natural killer cells express a variety of receptors, such particularly those within the Natural Killer Group 2 family of receptors. One such receptor, according to several embodiments disclosed herein, the NKG2D receptor, is used to generate cytotoxic signaling constructs that are expressed by NK cells and lead to enhanced anti-cancer activity of such NK cells. In addition, NK cells express the NKG2A receptor, which is an inhibitory receptor. One mechanism by which tumors develop resistance to immune cells is through the expression of peptide-loaded HLA Class I molecules (HLA-E), which suppresses the activity of NK cells through the ligation of the HLA-E with the NKG2A receptor. Thus, while one approach could be to block the interaction of the HLA-E with the expressed NKG2A receptors on NK cells, according to several embodiments disclosed herein, the expression of NKG2A is disrupted, which short circuits that inhibitory pathway and allows enhanced NK cell cytotoxicity.

CRISPR/Cas9 was used to disrupt NKG2A expression using the non-limiting examples of guide RNAs shown below in Table 3.

TABLE 3

NKG2A Guide RNAs

| SEQ ID NO: | Name | Sequence |
|---|---|---|
| 135 | NKG2A-1 | GGAGCTGATGGTAAATCTGC |
| 136 | NKG2A-2 | TTGAAGGTTTAATTCCGCAT |
| 137 | NKG2A-3 | AACAACTATCGTTACCACAG |

Other pathways that may impact immune cell signaling are edited, in several embodiments. One such example is the CIS/CISH pathway. Cytokine-inducible SH2-containing protein (CIS) is a negative regulator of IL-15 signaling in NK cells, and is encoded by CISH gene in humans. IL-15 signaling can have positive impacts on the NK cell expansion, survival, cytotoxicity and cytokine production. Thus, a disruption of CISH could render NK cells more sensitive to IL-15, thereby increasing their anti-tumor effects.

As discussed above, CRISPR/CAS9 was used to disrupt expression of CISH, though in additional embodiments, other gene editing approaches can be used. Non-limiting examples of CISH-targeting guide RNAs are shown below in Table 4.

TABLE 4

CISH Guide RNAs

| SEQ ID NO: | Name | Sequence |
|---|---|---|
| 130 | CISH-1 | CTCACCAGATTCCCGAAGGT |
| 131 | CISH-2 | CCGCCTTGTCATCAACCGTC |
| 132 | CISH-3 | TCTGCGTTCAGGGGTAAGCG |
| 133 | CISH-4 | GCGCTTACCCCTGAACGCAG |
| 134 | CISH-5 | CGCAGAGGACCATGTCCCCG |

FIG. 28A shows a schematic of a non-limiting embodiment of a gene editing approach used according to embodiment disclosed herein. Cells (e.g., NK cells) are electroporated at Day 0 in order to initiate gene editing though use of gene editing machinery. In several embodiments, CRISPR-Cas-based editing is used. Cells are cultured in high IL-2 media for one day, then expanded on feeder cells in low IL-2 media for an additional 6 days. At Day 7, cells are transduced with a viral construct encoding a CAR directed against a tumor and then expanded again for at least another 5 days prior to FACS analysis. In this experiment, double gene editing was performed to knock down expression of CD70 and the inhibitory receptor, NKG2A, or the combination of CD70 and TGFBR2 (CD70 knockout is shown above). FIG. 28B shows FACS analysis for expression of NKG2A after editing, while FIG. 28C shows the related control. Gene editing reduced NKG2A expression by over 50%, with less than 20% of the edited NK cells expressing the inhibitory receptor. FIG. 28D shows data for TGFBR2 expression post-editing, with FIG. 28E showing the related control. TGFBR2 express was reduced such that only about 3% of cells expressed the receptor. These data, in conjunction with the data above related to CD70 editing, demonstrate that immune cells, such as NK cells, can successfully be edited to alter expression of two or more target genes.

Having established that double knock out can be performed, the ability to express CARs as disclosed herein on the NK cells was also assessed. FIG. 29A shows expression of the NK71 CD70-targeting CAR on NK cells that were edited to reduce expression of CD70 (using CD70-1 guide RNA). Nearly 90% of the NK cells expressed the NK71 CAR. FIG. 29B shows the substantially eliminated expression of CD70 in those NK cells (only about 5% of the cells expressed CD70). FIG. 29B shows expression of the NK71 CAR by cells doubly edited to reduce CD70 and CISH expression. Again, nearly 90% of the doubly-edited NK cells expressed the NK71 CAR. FIG. 29D again confirms substantial reduction in CD70 expression on the NK cells. FIG. 29E shows expression of the NK71 CAR by cells doubly edited for CD70 and NKG2A. Over 90% of the doubly-edited NK cells expressed the CAR. As shown in FIG. 29F, CD70 expression was substantially reduced in these doubly-edited NK cells as well. FIG. 29G shows NK71 expression on NK cells doubly-edited to reduce expression of CD70 and TGFBR2, with over 87% of the cells expressing the CAR. As shown in FIG. 29H, CD70 expression was reduced by nearly 90% in these cells. FIGS. 29I and 29J show control data (mock gene editing, e.g., electroporation only). All data presented in FIG. 29 was obtained at Day 11 (4 days after transduction).

Data was collected on these say groups at Day 18 (11 days after transduction) to assess the persistence of the gene editing and the stability of CAR expression. Data for NK71 expression in CD70 knockouts is shown in FIG. 30A with corresponding CD70 expression data in FIG. 30B. Data for NK71 expression in CD70-CISH knockouts is shown in FIG. 30C with corresponding CD70 expression data in FIG. 30D. Data for NK71 expression in CD70-NKG2A knockouts is shown in FIG. 30E with corresponding CD70 expression data in FIG. 30F. Data for NK71 expression in CD70-TGFRB2 knockouts is shown in FIG. 30G with corresponding CD70 expression data in FIG. 30H. Corresponding control data is shown in FIGS. 30I and 30J. Of note in this data is that NK71 expression was maintained across each of the knockout groups and also that CD70 expression was further diminished in each group, with all groups showing 97% or more reduction in CD70 expression.

Viewing the expression data in another way, FIG. 31A shows a plot of the mean fluorescence intensity (MFI) detected, representing NK71 expression, after each of the gene editing approaches undertaken. As can be seen, each of the gene edited cells, regardless of single or double gene editing, expressed the NK71 CAR at elevated levels over control, with relatively consistent MFI across each gene editing approach. The percentage of NK71 positive cells (out of the entire population tested) is shown in FIG. 31B. Regardless of the gene editing approach undertaken, at least 60% of the NK cells expressed NK71. The single CD70 knockout and the combination CD70/CISH knockout expressed the greatest percentage of NK71, at almost 80% and about 85%, respectively. FIG. 31C shows the percentage of CD70 expression (in terms of percent reduction). As can be seen, each of the gene editing techniques, whether targeting CD70 alone, or in combination with other targets, yielded nearly 100% reduction in CD70 expression. FIGS. 32A-32B show corresponding data for the NK72-expressing NK cells. Together these data show that gene edited cells, whether with respect to editing a single target, or two targets, are still capable of expressing a CAR at significant levels of expression.

As various gene edits can impact signaling pathways (and thus increase or enhance, proliferation, cytotoxicity, and/or persistence), an experiment was performed to assess the impact of gene editing of proliferation of edited/engineered NK cells. $3\times10^5$ NK cells were transduced (on Day 7 after gene editing) with a viral construct encoding either the NK71 or NK72 CAR. Gene edits, single or double, were made as discussed above. FIG. 33A shows that, at Day 12 (5 days post-transduction), proliferation of CD70 knockout and CD70/TGFBR2 knockouts proliferated at about the same rate over the 5 days in culture. Interestingly, CD70/CISH showed substantially more (about 30%) more proliferation than either the CD70 knockout or the CD70/TGFBR2 knockout. In contrast, the CD70/NKG2A knockout showed reduced proliferation compared to all other groups. FIG. 33B shows a similar pattern in cell proliferation for cells transduced with the NK72 CAR.

Additional data was collected to evaluate the longer-term viability/proliferation of engineered/edited NK cells. Culturing of the engineered and edited NK cells was carried out to 35 days, with cell population viability measured at Day 14, 21, 28 and 35. The results are shown in Figured 34A and 34B for NK71-expressing and NK72-expressing NK cells, respectively. The pattern of viability in this experiment parallels the proliferation data discussed above. Regardless of the editing approach used, all the groups showed an upswing in overall viability between days 14 and 21. The CD70/NKG2DA group had the smallest increase, CD70 alone and CD70/TGFBR2 performed similarly and CD70/CISH outpaced each of the other groups. Moving from Day 21 to 28 and on to 35, each of the groups showed a decline in the viability of the populations, however, CD70/CISH edited cells showed the least decline over time, with the overall viability being substantially higher than the other groups as Day 35. In accordance with several embodiments, gene editing can enhance not only the ability of the edited cells to proliferate, but also enhance their viability as compared to unedited cells. In several embodiments, a dual modification (or more) can synergistically interact to yield robustly proliferating cells expressing a CAR, with enhanced viability of those cells. Advantageously, in several embodiments, these modifications lead to an easier generation of clinically relevant cell numbers.

Figure 35D:
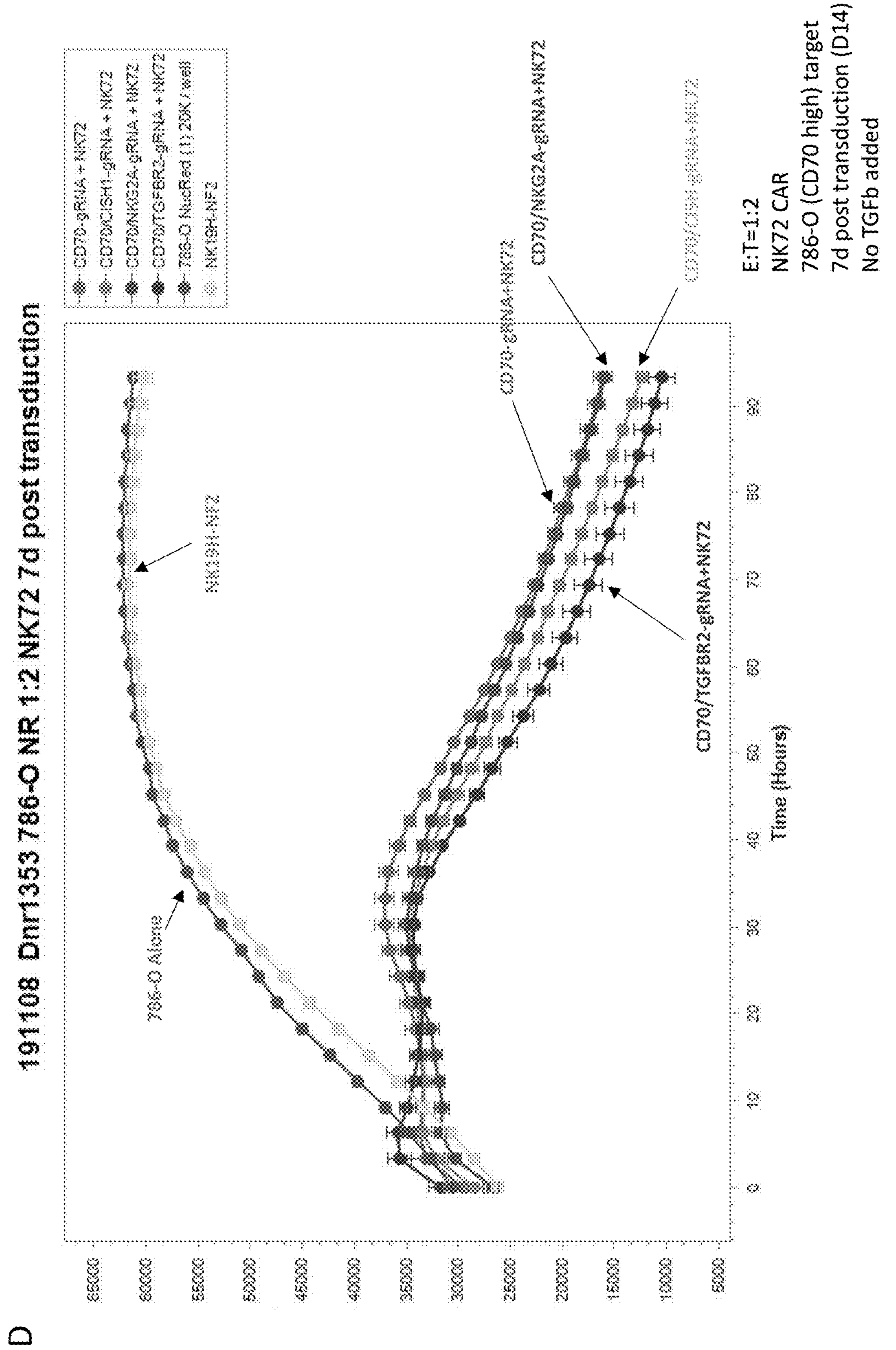

Having confirmed that edited and engineered cells express a CAR, proliferate successfully in culture, and have enhanced viability compared to un-edited cells, their anti-tumor effects were investigated. FIG. 35A shows cytotoxicity data of the indicated edited and engineered NK cells against 786-O cells, a renal cell carcinoma line expressing high levels of CD70. These edited NK cells were transduced with the NK71 CAR and cytotoxicity was measured starting at Day 14 post editing. TGFb, a cytokine that acts as an NK cell inhibitor in the tumor microenvironment, was not added here. A CD19-targeting CAR construct expressed by NK cells (unedited) was used as a control, as were 786-O cells cultured alone. At the E:T ratio of 1:1 each of the gene edited groups substantially reduced 786-O growth over the course of the experiment, with the end results being largely indistinguishable across the groups. FIG. 35B shows the same setup, but with an E:T ratio of 1:2. With the reduction in the number of effector NK cells, the various gene editing approaches begin to show distinct results. Each of the CD70, CD70/TGFBR2 and CD70/NKG2A groups successfully controlled 786-O tumor cell growth, but not to the same extent as the CD70/CISH edited NK71-expressing NK cells. This group showed not only a more rapid anti-tumor effect, but also an overall greater reduction in the tumor cell number. FIG. 35C shows corresponding data for NK cells edited and engineered to express the NK72 CAR, and using an E:T of 1:1. The data are similar to that of the NK71 construct, with all editing groups successfully controlling tumor growth. FIG. 35D shows NK72 cytotoxicity data at an E:T of 1:2. Similar to the NK71 cells, the editing approach undertaken causes some separation in the cytotoxicity of the NK cells, though less pronounced than with the NK71 CAR. Here, CD70 and CD70/NKG2A edited cells showed less robust tumor growth control. CD70/CISH edited NK cells successfully controlled growth (slightly improved over the prior two groups) and CD70/TGFBRR2 modestly outperformed the CD70/CISH cells. In accordance with several embodiments, the editing approach undertaken works in concert with a given CAR, and in some embodiments, a specific CAR may be more effective with a specific knockout or knockouts of target genes in the engineered cell.

FIGS. 36A-36D show corresponding data to that of 35A-35D, but using the ACHN tumor cell line as the target, as it expresses low levels of CD70. These data are indicative of not only the cytotoxicity of the engineered/edited NK cells through CD70-mediated means, but also through the normal cytotoxicity that NK cells would provide. FIG. 36A shows each of the edited NK-71 expressing cell groups effectively halting ACHN tumor cell growth at 1:1:E:T. FIG. 36B shows a large separation in the groups, with CD70/CISH edited cells showing robust anti-tumor effects. FIGS. 36C and 36D show similar patterns with CD70/CISH edited NK72-expressing cells showing the most effective tumor growth control. Thus, in several embodiments, gene editing enhances the cytotoxicity of engineered immune cells in a target-independent fashion. For example, according to several embodiments CD70/CISH editing imparts to NK cells expressing an anti-CD70 CAR a heightened ability to exert cytotoxic effects against the tumor, whether the target tumor is rich or sparse in marker identified by the CAR.

FIG. 37A shows additional cytotoxicity data against the 786-O RCC tumor cells, now at 14 days post-transduction (21 days post gene editing). A 1:2 E:T ratio is used here and an NKG2D-directed CAR-expressing NK cell (NKX101) is added for comparison. Those cells, from another donor, were previously engineered to express the NKG2D-OX40-CD3Z construct, expanded, frozen and were thawed for this comparative assay. NK71-expressing edited NK cells each showed robust tumor control, though the CD70/NKG2A group allowed greater amounts of tumor growth before leveling off and suppressing further increases. Further dilution of the effector cells (a 1:4 E:T ratio) again caused differences in the cytotoxicity of the various groups. CD70/NKG2A edited NK71-expressing NK cells showed the least amount of tumor growth control, with singly-edited CD70 edited NK71-expressing NK cells showing modest improvement. CD70/TGFBR2 edited cells exhibited a relatively consistent reduction in 786-O cell numbers after an initial peak about 2 days into the experiment. Notably the CD70/CISH edited NK cells reduced the growth of the tumor cells to the lowest level of any group, including those NK cells operating through a non-CD70 route. FIG. 38A shows corresponding data at a 1:2 ratio against ACHN cells. Given the lower CD70 expression on these cells, the CD70/NKG2A edited NK cells failed to control tumor growth, given that groups previously discussed reduced proliferation and viability. Each of the CD70 and CD70/TGFBR2 edited groups exhibited reasonable control of tumor growth. Most notable, however was that the CD70/CISH edited group nearly paralleled the significant suppression of tumor growth exhibited by NKG2D-targeting NK cells, despite the CD70/CISH cells being directed to a target that has reduced presence on this tumor cell line. This is in accordance with embodiments as discussed above, where the CD70/CISH gene editing positively impacts the edited NK cell in a non-target dependent manner, for example through enhanced generation of cytotoxic signals, improved metabolic profiles of the NK cell such that the edited NK cell population can expand to change the starting E:T ratio from the 1:2 starting point. This point is made more clear when seeing the results presented in FIG. 38B, wherein a 1:4 E:T ratio was used and all groups other than CD70/CISH-edited NK71-expressing NK cells allowed substantial tumor growth. In accordance with several embodiments disclosed herein, gene editing of CD70 and CISH in combination results in edited immune cells, e.g., NK cells, that are unexpectedly effective against tumor cells, even those expressing limited quantities of the targeted marker. FIGS. 39A-39B show corresponding data for NK cells expressing the NK72 CAR, with generally similar trends in the data, in that, of the edited cells, the CD70/CISH edited cells outperform the other editing approaches undertaken in terms of controlling 786-O cell growth. Likewise, FIGS. 40A and 40B show corresponding data for NK72-expressing edited NK cells against low-CD70 ACHN cells. As above, CD70/CISH edited cells showed the most robust tumor cell growth control. In accordance with several embodiments, CD70 and CISH editing drive the edited NK cells (or T cells) to exhibit unexpectedly superior anti-tumor effects, even at lower initial E:T ratios. As discussed above, in several embodiments, the CD70 and CISH editing allow the NK cells to avoid the suicide effect of the anti-CD70 CAR and also upregulate various aspects of the edited NK cell metabolism and/or cytotoxic actions.

Further experiments were conducted to evaluate the CD70/CISH knockouts and their enhanced anti-tumor effects. FIG. 41A shows the embodiment of gene editing and engineering used for this example and FIGS. 41B-41O show the expression results. Guide RNAs used were CD70-1 and CISH-1, in this experiment. Edited NK cells were transduced at Day 7 with viral constructs encoding either NK71 or NK72. FIG. 41B is an unstained control and FIG. 41C is a CD70 positive control cell. FIG. 41D shows CD70 expression on NK cells after editing and FIG. 41D shows NK71 expression. FIGS. 41F-41G show corresponding data for CD70 and NK72 expression, respectively. FIGS. 41H-41I show corresponding data for CD70 and NK71 expression, respectively, when both CD70 and CISH were edited. FIGS. 41J-41K show corresponding data for CD70 and NK72 expression, respectively, when both CD70 and CISH were edited. FIGS. 41L-41M show corresponding data for CD70 and NK71 expression, respectively, when cells were exposed only to electroporation (no guide RNA/CRISPR) and transduction with NK71. FIGS. 41N-41O show corresponding data for CD70 and NK72 expression, respectively, when cells were exposed only to electroporation (no guide RNA/CRISPR) and transduction with NK72. As discussed above, these approaches yield substantial, if not total reduction in the amount of CD70 and/or CISH expressed by the NK cells. If expression is not reduced to below detectable levels, according to several embodiments, the function of the related pathways of CD70 and/or CISH is substantial or significantly disrupted. Having disrupted both CD70 and CISH expression, the cytotoxicity of NK71 and NK72 expressing NK cells was evaluated. FIG. 42A shows cytotoxicity data against 786-O cells by NK71-expressing NK cells having been edited in the indicated manner. An E:T of 1:2 was used and as indicated the NK cells were pre-treated overnight with (or without) TGFbeta in culture prior to the experiment and during the experiments. As mentioned above, TGFbeta is a cytokine that is released by tumor cells into the tumor microenvironment and is one way by which certain tumors evade immune cells. As with the data discussed above, CD70/CISH-edited NK cells were able to control tumor growth. Notably, however, is the ability of CD70/CISH-edited NK cells to substantially control tumor growth after pre-treatment with and in the presence of TGFb. Given that TGFb inhibits immune cell activity, the presence of TGFb would be expected to limit the ability of the NK71-expressing NK cells to effectively control the growth of the tumor cells, an effect seen in the CD70-edited NK71-expressing NK cells treated with TGFb, which controlled tumor growth in a manner indistinguishable from control. Unexpectedly, the CD70/CISH edited cells exposed to TGFb controlled tumor growth nearly as well as those cells not inhibited by the presence of TGFb. These effects are seen on the low-CD70-expressing ACHN cells, in FIG. 42B. In this experiment, one would have expected the experimental groups with TGFb present to show limited ability to control ACHN cell growth, as the ACHN cells lack the robust CD70 expression of certain cells, like 786-0, and the TGFb would be expected to inhibit the NK cells. What the data in FIG. 42B show, unexpectedly, is that the CD70/CISH editing, even in the presence of the inhibitory TGFb, enables NK cells to achieve tumor growth control on par with those experimental groups not exposed to the inhibitory signals of TGFb. In some embodiments, the CISH knockout enables the edited cells to overcome the inhibitory effect of TGFb, in a substantial, if not complete manner. In several embodiments, this endows the CD70-CISH edited NK cells expressing a CAR, such as an anti-CD70 CAR with enhanced ability to effectively control tumor progression, with the cytotoxic effects limiting, if not reducing and/or eliminating tumor cells. FIG. 42C shows corresponding cytotoxicity data for edited NK cells engineered to express the NK72 CAR. As discussed above, the CD70/CISH edited NK cells show substantial anti-tumor effects, even in the presence of the inhibitory TGFb cytokine, which corresponds to several embodiments of the edited and engineered NK cells disclosed herein.

Example 4—Further Editing of Multiple Genes, Including Tumor Microenvironment-Related Genes According to several embodiments disclosed herein, gene editing of NK and/or T cells results in the edited cells having increased resistance to inhibitory factors that may be present in the tumor microenvironment. In addition to the experiments discussed above, additional experiments were conducted to further evaluate the effects of gene editing on NK (or T cell) cytotoxicity.

As discussed above, NK cells express endogenous CD70 and expression of an anti-CD70 CAR (designed to target a CD70-expressing tumor) would result in destruction of the engineered NK cell population due to lack of differentiation between the CD70-expressing NK cells and CD70-expressing tumor cells. Thus, several embodiments in which NK cells are engineered to express CD70 also include gene editing to reduce, or knockout, CD70 expression by the NK cells. FIGS. 43A-43I show data related to the gene editing of NK cells to knockout CD70 expression using different guide RNAs, or combinations of guide RNAs (expression evaluated at 7 days post-electroporation). FIG. 43A shows that use of CRISPR-Cas9 gene editing with CD70-1 guide RNA reduced CD70 expression by over 75%. Editing using CD70-2 guide RNA reduced CD70 expression by over 60% (43B). Editing using CD70-3 guide RNA reduced CD70 expression by over 55% (43C). The combination of guide RNA 1 and 3 reduced CD70 expression on NK cells by over 75% (43D). The combination of guide RNA 1 and 2 also reduced CD70 expression on NK cells by over 75% (43E). The combination of guide RNA 2 and 3 reduced CD70 expression on NK cells by nearly 85% (43F). As discussed herein, in several embodiments, multiple genes are edited in combination. FIG. 43G shows reduced expression of CD70 (by almost 80%) when NK cells were edited using CD70-1 guide RNA in combination with guide RNA (CISH-1) targeting CISH. Similarly, CD70 expression was reduced by over 80% when CD70-1 guide RNA was used in combination with three guide RNAs targeting the adenosine receptor (A2AR). The three, non-limiting examples of guide RNAs targeting A2AR are shown in Table 5.

TABLE 5

Adenosine Receptor (A2AR) Guide RNAs

| SEQ ID NO: | Name | Sequence |
|---|---|---|
| 396 | A2AR-1 | CGAGGAGCCCATGATGGGCA |
| 397 | A2AR-2 | GGGCAATGTGCTGGTGTGCT |
| 398 | A2AR-3 | CAGTGACACCACAAAGTAGT |

These data demonstrate that targeting multiple genes in combination does not reduce the effectiveness of CD70 gene editing. FIG. 43I show control (electroporation only) CD70 expression on NK cells.

Data regarding the cytotoxicity of these various constructs. FIG. 44A shows the percent cytotoxicity of the gene edited NK (note, for this data, the NK cells were not engineered to express a CAR) cells against REH tumor cells at either a 1:1: or 1:2 E:T ratio. These gene edited cells exhibited between about 35-50% cytotoxicity against the REH tumor cells at a 1:1 E:T ratio, while the electroporation only (EP) and un-edited (UN) NK cells yielded about 20-25% cytotoxicity at 1:1 E:T ratio. Shifting to a 1:2 E:T ratio decreased the cytotoxicity of all groups, with the controls dropping to about 10% and the majority of the edited cells yielding between about 20-30% cytotoxicity. These data are also shown in a different manner in FIGS. 44B (1:1) and 44C (1:2), which allow for additional insight into how various edits may impact the efficacy of NK cells. Editing of NK cells with any of CD70-1, or -2 guide RNAs alone resulted in similar cytotoxicity. Use of guide RNA CD70-3 or CD70-1+3 appeared to slightly improve cytotoxicity. In contrast, the combination of guide RNA CD70-

2+3 or 1+2 appeared to lower cytotoxicity. CISH and A2AR edited NK cells each exhibited cytotoxicity in the same (CISH) or slightly higher (A2AR) as the CD70 edited cells at a 1:1 E:T ratio. A similar pattern is shown in FIG. 44C, with a 1:2 E:T ratio. These data demonstrate that, in some embodiments, a particular guide RNA can work particularly well. However, these data also show that, even with some slight variance in the change in cytotoxicity between the editing machinery used, editing causes an increase in cytotoxicity (e.g., through resistance to TME signaling) as compared to non-edited cells.

FIG. 44D shows additional data evidencing further increases in cytotoxicity when gene edited cells are engineered to express anti-tumor CARs. In this experiment Nalm6 cells were used as the target tumor cell and were incubated with various NK cells at a 1:1 E:T ratio (20,000 target cells). As expected, Nalm6 cells alone increased throughout the course of the experiment. Nalm6 cells incubated with control NK cells (either electroporated only (EP) or un-electroporated (UN) showed reduced growth over time, as compared to Nalm6 alone. Editing NK cells (but not engineering) further reduced Nalm6 grown as shown by the two traces for CD70-1 and CD70-2. Those NK cells edited using CD70-1 or CD70-2 guide RNA and engineered to express a non-limiting embodiment of a CD19-targeting CAR, as well as non-edited NK cells engineered to express the same CAR resulted in complete eradication of the target Nalm6 tumor cells. Thus, according to several embodiments, expression of an anti-tumor CAR and gene editing of an immune cell, such as an NK cell, yields a highly cytotoxic edited/engineered cell. In several embodiments, other aspects of the edited/engineered cell are enhanced, such as the life span of the cell (e.g., persistence), particularly persistence in vivo, the ability of the cells to be expanded and/or stored, and the like. In several embodiments, the editing allows the edited and engineered cells to be used at lower E:T ratios, but still effectively control tumor growth.

FIG. 45A further explores the effects of gene editing, with CD70-knockout NK cells also being edited for either CISH knockout or adenosine receptor (A2AR) knockout. The indicated edited cells (non-engineered) or control cells (electroporation only (EP) or un-electroporated (UN)) were incubated with Reh tumor cells at a 1:1 E:T ratio (20,000 NK cells). Control Reh cells expanded significantly in the first several days of the experiment with growth plateauing and maintaining elevated population levels for the duration of the experiment. Control EP and UN NK cells delayed Reh cell expansion in the initial phases, but eventually the Reh cells began rapid expansion near the close of the co-culturing. In contrast, CD70-edited cells (CD70-1 gRNA) allowed only modest growth in the last day of the experiment. Likewise, editing with CD70-1 gRNA in combination with editing CISH resulted in even further control to Reh tumor cell growth. Following in this trend, editing with CD70-1 gRNA in combination with editing the adenosine receptor resulted in the greatest control of Reh cell growth. FIG. 45B shows similar experimental results, but with an E:T ratio of 1:2. These data shows that the relative performance of the dually-edited NK cells is more condensed, making it more difficult to determine which set of cells is exhibiting the greater cytotoxicity. However, this data also confirms either single, or multiple, gene edits to reduce, or eliminate in several embodiments, expression of certain genes, such as CISH, A2AR, or other genes related to the immune suppressive nature of the tumor microenvironment, yield immune cells (e.g., NK cells or T cells, depending on the embodiment) with enhanced tumor-directed cytotoxicity.

As discussed above, in several embodiments, other characteristics of the edited immune cells may also be enhanced, e.g., persistence, expansion capacity, etc.

Further investigation into the enhanced anti-tumor effects of gene edited immune cells was undertaken by gene editing certain tumor microenvironment related genes in conjunction with engineering the immune cells, here NK cells, to express an anti-CD70 CAR (to target CD70-expressing tumor cells). FIGS. 46A-46J show FACS analysis of various gene edits in conjunction with engineering to induce expression of a non-limiting embodiment of an anti-CD70 CAR, here NK71. FIG. 46A shows the distribution of NK cells that are (i) positive for NK71 expression and (ii) negative for CD70 express (based on editing the NK cells used with guide RNA CD70-1). Approximately 84% of the NK cells sampled met this expression profile. Similarly, about 85% of the NK cells sampled exhibited NK71 expression and reduced CD70 expression with the editing of the cells using CD70-2 guide RNA (FIG. 46B). Slightly higher degrees of NK71-expressing/CD70-edited cells were detected when CD70 was edited using guide RNA CD70-3 or the combination of guide RNA CD70-1 and -3 (nearly 87% for both; FIGS. 46C-46D). Use of guide RNAs CD70-2 and -3 yielded almost 90% of the NK cells sampled with this phenotype (FIG. 46E). Similarly, use of guide RNA CD70-1 and -2 yielded over 85% of the NK cells sampled with this phenotype (FIG. 46F). Similar numbers resulted when editing the cells using both CD70-1 to knockdown CD70 expression and CISH-1 guide RNA to knock down CISH expression (~84%, FIG. 46G) and CD70-1 to knockdown CD70 expression and A2AR-1, -2, and -3 guide RNA to knock down A2AR expression (FIG. 46H). FIGS. 461 and 46J show control data. Together, these data confirm that significant numbers of immune cells, such as NK cells, can successfully be both edited (with multiple targets, in several embodiments) and engineered to express a tumor-targeting CAR.

Having shown that immune cells, such as NK cells, could be both edited (multiple targets in several embodiments) and engineered to express a CAR, experiments were performed to determine the cytotoxicity of such cells. 786-O cells, a renal cell carcinoma cell line known to express high levels of CD70, was used as the target tumor cell for a portion of this experiment. FIG. 47A shows the experimental results when the various NK cell constructs are present in a 1:2 E:T ratio (10,000 NK cells). As would be expected the negative control 786-O cells alone expanded quickly and maintained a relatively high cell count throughout the experiment. Electroporated only cells (EP) allowed for a fairly robust early stage increase followed by a long, tapered decline, starting around 2 days after co-culture with the 786-O cells. CD70-1 guide RNA edited cells showed a similar pattern but with improved overall control in tumor cell numbers. With an overall cytotoxicity profile resembling those of CD70-1 guide RNA edited cells in shape only, those cells that were additionally engineered to express NK71 (a non-limiting CD70-targeting CAR) exhibited profoundly more favorable control of tumor expansion. Notably, in this experiment, the profound control of tumor growth is at a 1:2 E:T ratio, indicative of the highly effective nature of cells according to embodiments disclosed herein against tumor cells generally, but in particular against cells expressing elevated levels of the target of a CAR expressed by edited/engineered cells.

Further demonstrating the enhanced cytotoxicity against cells expressing elevated levels of a tumor marker targeted by a CAR expressed by edited and/or engineered immune cells is the data shown in FIG. 47B. The experimental setup here reduced the E:T ratio to 1:4 (5,000 NK cells) and used high-CD70 expressing Reh cells and the indicated edited and/or edited and engineered NK cells. As can be seen in this data, the editing of NK cells to reduce expression of NK cells continued to allow the edited CD70 knockout cells (CD70-1) to control tumor growth more effectively than control NK cells. The additional engineering of the edited NK cells to express an anti-CD70 CAR (CD70+ NK71) further improved the cytotoxic effects. Advantageously, editing multiple genes in the NK cells, either CD70+CISH or CD70+A2AR, coupled with engineering the cells to express an anti-CD70 CAR yielded still further improvements in cytotoxicity against the target 786-O cells, most notably with A2AR editing. Similar trends are shown in FIG. 47C, where the E:T ratio was further reduced (1:8, 2,500 NK cells). These data further demonstrate the enhanced cytotoxicity against target cells that is induced as a result not only of editing an immune cell, like an NK cell, but the unexpectedly enhanced cytotoxicity that results from editing multiple targets (such as TME-related genes) in conjunction with engineering of the cells to express a CAR.

Further demonstrating the advantage of targeting a tumor marker that is prevalent on a target cell with a CAR specific to that marker is the data presented in FIGS. 47D-47F, which employed co-culture of various edited and/or edited and engineered NK cells against ACHN tumor cells, which express relatively low levels of CD70. As can be seen in FIG. 47D (1:2 E:T, 10,000 NK cells), editing of CD70 alone resulted in NK cells with cytotoxicity on par with that of NK cells subjected to electroporation alone (EP). Tumor growth in this experimental setup was similar, whether NK cells were present or not, suggesting the ACHN cells grow and expand through a series of signals that does not involve expression of CD27, the binder for CD70 (normally expressed by NK cells), or involves some other TME-signaling moiety that blocks/reduces immune cell function, otherwise, the CD70-1 guide RNA NK cells would have been expected to perform more poorly than EP cells alone. Even with the relatively low expression of CD70 in ACHN cells, the engineering of the NK cells to express NK71, a non-limiting example of an anti-tumor CAR, yielded substantial improvements in reducing tumor growth as compared to control, though overall, there was still increased tumor cell count over time. These trends are exemplified in FIGS. 47E and 47F, which employed 1:4 and 1:8 E:T ratios, respectively (target cell number is held constant at 20,000 cells in these cytotoxicity assays). This effectively dilutes the effector cells as compared to the targets, and without the ability to bind an overexpressed CD70 via the CAR, ACHN tumor growth progressed to levels indistinguishable from control. These data support the approach that, for a given cancer, gene editing in conjunction with engineering an immune cell with a CAR targeting a marker expressed by the target tumor cell can yield enhanced resistance to immune suppressive signals from the tumor microenvironment and ultimately yield enhanced cytotoxicity, persistence and/or overall efficacy against a tumor.

To further elucidate the ability of gene editing of immune cells, such as NK cells, additional experiments were conducted comparing the cytotoxicity of gene edited cells engineered to express a non-limiting embodiment of a CAR directed against CD70, here NK71 in the presence and absence of an inhibitor of the gene that was edited. In this experiment, NECA, a high affinity adenosine receptor agonist was used. NECA has Ki (inhibitory concentration) of 6.2, 14, and 20 nM for human adenosine receptor subtypes A3, A1 and A2A receptors respectively and an EC50 of 2.4 μM for human A2B receptor. Adenosine (e.g., extracellular adenosine in the blood stream) acts on immune cells, including NK cells, by binding to one of these four adenosine receptors, most notably the A2A receptor (A2AR), with a resultant suppression of NK cell immune function. Thus, the presence of NECA in the co-culture of tumor cells and NK cells would be expected to negatively impact the cytotoxic function of the NK cells. As can be seen in FIG. 48A (in the cytotoxicity plot) and 48B (histogram), as compared to NK cells expressing NK71 alone with NECA in the co-culture with 786-O cells, NK cells expressing NK71 and edited for A2AR disruption, the latter NK cells exhibited a greater degree of cytotoxicity. Comparisons of these two groups are indicated by dashed lines. Note that FIG. 48A does not include a trace for 786-O cells alone, which allows for greater visual separation of the cytotoxicity curves for the various treatment groups. Additional data is shown on FIGS. 48C and 48D. Here, an E:T of 1:2 was used (1:1 used in 48A) and the tested constructs show relatively similar cytotoxicity profiles (again with a control not shown to reduce compaction of the line graphs in FIG. 48C. The histogram of 48D summarizes this data. As can be seen CISH editing of NK cells increases the cytotoxic effects of NK cells expressing NK71 (compare $1^{st}$ vs. $2^{nd}$ histogram bar). Interestingly, editing of CISH ($5^{th}$ bar) as well as editing of A2AR ($6^{th}$ bar) resulted in increased cytotoxicity (less signal detection from tumor cells), even when NECA was present ($4^{th}$ bar). It is contemplated that there may be some common downstream signaling between CISH and A2AR that account for this resistance to NECA, which mimics an agonist-based suppression of NK cell function as may be seen in the tumor micro-environment. Thus, according to several embodiments, editing CISH and/or A2AR (or another target involved in tumor micro-environment-related immune cell suppression) in an immune cell, such as an NK cells, can not only provide a degree of resistance to immune suppressive effects of the tumor microenvironment, but can act synergistically with an anti-tumor CAR expressed by the immune cell, such as an anti-CD70 CAR to result in enhanced cytotoxicity against a tumor. This approach can also, according to several embodiments, result in other improved characteristics of the cells, such as enhanced persistence (especially in the tumor microenvironment), increased expansion capacity; increased target specificity, and reduced dosage requirements (either lower numbers of administered cells or increased time between doses, among others.

Additional genes known to affect NK cell activity were also investigated. More specifically, the genes mothers against decapentaplegic homolog 3 (SMAD3), MAP kinase-activated protein kinase 3 (MAPKAPK3), carcinoembryonic antigen-related cell adhesion molecule 1 (CEACAM1), and DNA-damage-inducible transcript 4 (DDIT4) were investigated. SMAD3 is an intracellular downstream signaling protein for the TGFb ligand superfamily. SMAD3-mediated TGFb receptor or ALK4 signaling may lead to inhibition in NK cells. MAPKAPK3 activity suppresses IFN-gamma gene expression and attenuates NK cell cytotoxicity. CEACAM1 is a checkpoint molecule on the NK cell surface, and is highly upregulated during NK cell feeder expansion. DDIT4 is a negative regulator of mTORC1; mTORC1 enables IL-15 mediated NK cell survival, proliferation, cytotoxicity, and glucose metabolism. Therefore, it was examined whether knocking out these genes would improve efficacy of anti-CD70 CAR NK cells. Non-limiting embodiments of guide RNAs for disrupting SMAD3, MAPKAPK3, CEACAM1, and DDIT4 are provided in Table 6.

TABLE 6

| Additional guide RNAs | | | |
|---|---|---|---|
| SEQ ID NO: | Target | Name | Sequence |
| 1190 | SMAD3 | SMAD3 guide RNA 1 | CCGATCGTGA AGCGCCTGCT |
| 1191 | SMAD3 | SMAD3 guide RNA 2 | CGAGAAGGCG GTCAAGAGCC |
| 1192 | SMAD3 | SMAD3 guide RNA 3 | CTTGGTGTTG ACGTTCTGCG |
| 1193 | MAPKAPK3 | MAPKAPK guide RNA 1 | CTCTGCTGTT TCACCATCCA |
| 1194 | MAPKAPK3 | MAPKAPK guide RNA 2 | CCCGGCTTGG GCGGTGCTCC |
| 1195 | MAPKAPK3 | MAPKAPK guide RNA 3 | CGACTACCAG TTGTCCAAGC |
| 1196 | CEACAM1 | CEACAM1 guide RNA 1 | GACTGAGTTA TTGGCGTGGC |
| 1197 | CEACAM1 | CEACAM1 guide RNA 2 | GAATGTTCCA TTGATAAGCC |
| 1198 | CEACAM1 | CEACAM1 guide RNA 3 | GAGAGGCTGA GGTTTGCCCC |
| 1199 | DDIT4 | DDIT4 guide RNA 1 | CCTCACCATG CCTAGCCTTT |
| 1200 | DDIT4 | DDIT4 guide RNA 2 | CGATCTGGGG TGGGAGTTCG |
| 1201 | DDIT4 | DDIT4 guide RNA 3 | GTTTGACCGC TCCACGAGCC |

An non-limiting schematic of an anti-CD70 CAR and a gene editing/expansion protocol is provided in FIG. 49A. NK cells were first gene edited (e.g. using CRISPR/Cas electroporation) to doubly knockout CD70 and one of these target genes. Electroporated cells were cultured in high IL-2 conditions and subsequently with IL-12 and IL-18 to expand NK cells. At day 7 after gene editing, NK cells were transduced with a virus harboring a CAR genetic sequence, for example NK71 (as seen in FIG. 6). Following transduction, NK cells were assessed for CAR expression and used for cytotoxicity assays. At day 7 following double knockout of CD70 and a target genes (SMAD3, MAPKAPK3 [MK3], CEACAM1, DDIT4, A2AR, NKG2A, CISH), CD70 expression was reduced consistently among different conditions (FIG. 49B). At day 10 following double knockout (and NK71 CAR transduction at day 7), CD70 expression was essentially undetectable and NK71 expression was consistent among different conditions (FIG. 49C). NK cell populations gene edited for the targets were amplified at the targeted loci at their respective exons as shown in FIG. 49D. Gene loci amplicons were sequenced to determine indel frequency within the NK cell population (FIG. 49D).

SMAD3 was knocked out in an NK cell population expressing the NK71 CAR. Loss of SMAD3 protein was confirmed by Western blot as well as loss of phosphorylated SMAD3 signal after TGFb treatment (FIG. 49E). Cytotoxicity assays were performed with NK cell populations knocked out for SMAD3 or CISH and expressing the NK71 CAR, with or without treatment of 20 ng/mL TGFb (FIGS. 49F-49G). Unlike the CISH knockout population, the SMAD3 knockout could not overcome TGFb inhibition of NK71 cell cytotoxicity, as seen by the greater number of remaining tumor cells in the SMAD3 KO+ TGFb treated condition compared to TGFb treated only condition.

A2AR was knocked out in an NK cell population expressing the NK71 CAR. Cytotoxicity assays were performed with NK cell populations knocked out for A2AR or CISH and expressing the NK71 CAR, with or without treatment of the adenosine receptor agonist NECA at 10 uM (FIG. 49H-49I). The results observed here were similar to those discussed above (e.g. FIG. 48). The cytotoxicity assay results suggest that A2AR knockout or CISH knockout may overcome NECA inhibition of NK71 cell cytotoxicity.

MAPKAPK3 (MK3) was knocked out in an NK cell population expressing the NK71 CAR. Cytotoxicity assays were performed with NK cell populations knocked out for MK3 or CISH and expressing the NK71 CAR (FIGS. 49J-49K). MK3 knockout moderately enhances NK cell cytotoxicity.

NKG2A was knocked out in an NK cell population expressing the NK71 CAR. Cytotoxicity assays were performed with NK cell populations knocked out for NKG2A or CISH (or MK3 for comparison) and expressing the NK71 CAR. NKG2A knockout increases NK cell cytotoxicity against 786-O tumor cells (FIGS. 49L-49N) under normal conditions. However, NKG2A knockout fails to overcome inhibition of NK cells when tested in either 20 ng/mL TGFb (1:1 E:T; FIG. 49O) or 10 μM NECA (1:2 E:T; FIG. 49P).

DDIT4 was knocked out in an NK cell population expressing the NK71 CAR. Cytotoxicity assays were performed with NK cell populations knocked out for DDIT4 or CISH and expressing the NK71 CAR (FIG. 49Q-49R). Cells were treated with 50 μM $CoCl_2$ to induce a hypoxic state, which induces DIT4 to inhibit mTor. DDIT4 knockout was not found to enhance NK cell cytotoxicity.

CEACAM1 was knocked out in an NK cell population expressing the NK71 CAR. Cytotoxicity assays were performed with NK cell populations knocked out for CEACAM1 or CISH and expressing the NK71 CAR (FIGS. 49S-49T). CEACAM5, which can be found on tumor cell surfaces and interacts with CEACAM1, was added at 1 μg/mL. CEACAM1 knockout was not found to enhance NK cell cytotoxicity.

NK cell populations edited to knock out CISH, A2AR, SMAD3, MK3, DDIT4, or CEACAM1 (over 42 days, FIG. 49U); or CISH or NKG2A (over 49 days, FIG. 49V) were assessed to observe NK cell proliferation and survival as measured by cell counts. CISH knockout was found to have the greatest benefit for NK cell survival at the final time point tested. Thus, in several embodiments, CISH is edited to impart beneficial effects to NK or T cells expressing one or more of the anti-CD70 CAR constructs disclosed herein. In additional embodiments, genes in addition to CISH are edited to provide further benefits, which in some embodiments synergistically work with those of CISH-edited cells to result in highly efficacious and persistent edited cells for use in CD70-expressing tumor therapy.

Example 5—Anti-CD70 Binding Domain Screening and Characterization

As discussed above, various anti-CD70 binding domains were produced and evaluated for expression, cytotoxicity against target cells and otherwise were characterized according to the non-limiting methodologies and experiments described herein.

A pool of 1600 candidate anti-CD70 binding domains were screened to identify nearly 1000 unique scFvs. These were further screened based on their ability to bind either or both a monomer or trimer of CD70 epitopes and their ability to compete with (or block) binding of a known anti-CD70 binder to such CD70 epitopes. Testing against CD70 trimers allows for identification of binders selective for the naturally occurring trimeric conformation of CD70, whereas testing against CD70 monomers allows for selection of high affinity binders.

Based on the CD70 binding assays, 74 individual scFvs were identified and selected for further characterization. Non-limiting examples of nucleotide sequences for the selected scFvs are provided in SEQ ID NOs: 38-111. Non-limiting examples of nucleotide sequences for separate heavy chain variable regions (VH) of the selected scFvs are provided in SEQ ID NOs: 1038-1111. Non-limiting examples of nucleotide sequences for separate light chain variable regions (VL) of the selected scFvs are provided in SEQ ID NOs: 1112-1185. Peptide sequences for the selected scFvs are provided in SEQ ID NOs: 230-303. Peptide sequences for separate VH of the selected scFvs are provided in SEQ ID NOs: 890-963. Peptide sequences for separate VL of the selected scFvs are provided in SEQ ID NOs: 964-1037. It is envisioned that other nucleotide sequences that the ones provided (e.g. sequences having at least 80%, 85%, 90%, 95%, 96%, 97%, 98%, or 99% homology) can be translated to the same peptide scFv sequences as conventionally understood. Non-limiting examples of nucleic acid and peptide sequences for each of the 74 selected anti-CD70 scFvs are depicted in FIG. 50A.

Bivalent scFvs were prepared from some of the selected anti-CD70 scFvs. The bivalent scFvs that were prepared include: 1) NK77.38/NK77.38, 2) NK77.64/NK77.64, 3) NK77.65/NK77.65, 4) NK77.38/NK77.67, 5) NK77.38/NK77.68, 6) NK77.64/NK77.67, 7) NK77.64/NK77.68, 8) NK77.65/NK77.67, 9) NK77.65/NK77.68. The names of the bivalent combinations correspond to the nomenclature used for the monovalent scFvs as disclosed herein (e.g. in FIG. 50A). Non-limiting examples of nucleotide sequences for these bivalent scFvs are provided in SEQ ID NOs: 112-120. Corresponding peptide sequences for these bivalent scFvs are provided in SEQ ID NOs: 304-312.

Also provided are individual heavy chain variable region and light chain variable region complementarity determining regions (CDRs). Non-limiting examples of CDR-H1 are provided in SEQ ID NOs: 428-501. Non-limiting examples of CDR-H2 are provided in SEQ ID NOs: 502-575. Non-limiting examples of CDR-H3 are provided in SEQ ID NOs: 576-649. Non-limiting examples of CDR-L1 are provided in SEQ ID NOs: 668-741. Non-limiting examples of CDR-L1 are provided in SEQ ID NOs: 742-815. Non-limiting examples of CDR-L1 are provided in SEQ ID NOs: 816-889. Combinations for each of the selected anti-CD70 scFvs are provided in FIG. 50B. It is envisioned that other anti-CD70 scFvs (or sdAbs) can be produced by other combinations of the heavy chain and light chain CDRs provided herein.

The anti-CD70 scFvs disclosed herein are produced within immunoglobulin frameworks conventionally known in the art. For example, each heavy chain variable region and light chain variable region framework used has 4 framework sequences (FW-1, FW-2, FW-3, FW-4) in which the three CDRs are provided. Non-limiting examples of FW-H1 are provided in SEQ ID NOs: 399-402. Non-limiting examples of FW-H2 are provided in SEQ ID NOs: 403-406. Non-limiting examples of FW-H3 are provided in SEQ ID NOs: 407-422. Non-limiting examples of FW-H4 are provided in SEQ ID NOs: 423-427. Non-limiting examples of FW-L1 are provided in SEQ ID NOs: 650-653. Non-limiting examples of FW-L2 are provided in SEQ ID NOs: 654-657. Non-limiting examples of FW-L3 are provided in SEQ ID NOs: 658-661. Exemplary FW-L4 are provided in SEQ ID NOs: 662-667. It is envisioned that alternative frameworks may be substituted for any of the frameworks disclosed herein as understood by one skilled in the art.

CARs were prepared from these selected 74 anti-CD70 scFvs. The CARs were constructed with the anti-CD70 scFv, a CD8a hinge, a CD8a transmembrane domain, an OX40 subdomain, and a CD3zeta subdomain, as depicted in FIG. 6, however, according to additional embodiments, other domains disclosed herein may also be used (e.g., 4-1 BB, CD28, etc.). Non-limiting examples of nucleotide sequences for the monovalent CARs are provided in SEQ ID NOs: 138-211. Non-limiting examples of nucleotide sequences for the bivalent CARs are provided in SEQ ID NOs: 212-220. Additional non-limiting examples of codon-optimized sequences for the bivalent CARs are provided in SEQ ID NOs: 221-229. Corresponding peptide sequences for the monovalent CARs are provided in SEQ ID NOs: 313-386. Corresponding peptide sequences for the bivalent CARs are provided in SEQ ID NOs: 387-395.

These initial 74 CARs were assayed for tonic signaling and activation capability in Jurkat cells. A schematic for this is depicted in FIG. 50C. Briefly, Jurkat cells that previously have been gene edited to knock out CD70 are transduced with a standard titer of virus harboring anti-CD70 CAR genetic sequences, expanded, and the cultured either alone (to test tonic signaling) or co-cultured with tumor cells to test CAR-mediated activation. Activation was measured by CD69 expression. Most of the prepared anti-CD70 CARs do not exhibit substantial tonic signaling, with the exception of clones NK77.48 and two bivalent CARs NK77.78 (NK77.65 duplicate bivalent) and NK77.83 (NK77.65/NK77.67 bivalent) (FIG. 50D). The ratio of activation after tumor cell co-culture to tonic signaling indicates which constructs function efficiently to transduce immune cell activation (FIG. 50E). From this screening, a set of 10 CAR constructs (NK77.11, NK77.16, NK77.17, NK77.31, NK77.44, NK77.55, NK77.58, NK77.65, NK77.71, NK77.73) (FIG. 50F). The majority of anti-CD70 CARs tested in subsequent assays are part of this set of 10 selected CARs, although any of the anti-CD70 CARs disclosed herein, in any combination, may be similarly assayed and/or used in a cell therapy composition or method disclosed herein.

In some embodiments, also provided herein are nucleic acid or amino acid sequences that have sequence identity and/or homology of at least 80%, 85%, 90%, 95%, 96%, 97%, 98%, 99% (and ranges therein) as compared with the respective nucleic acid or amino acid sequences of SEQ ID NOS. 138-395 (or combinations of two or more of SEQ ID NOS: 138-395) and that also exhibit one or more of the functions as compared with the respective SEQ ID NOS. 138-395 (or combinations of two or more of SEQ ID NOS: 138-395) including but not limited to, (i) enhanced proliferation, (ii) enhanced activation, (iii) enhanced cytotoxic activity against cells presenting ligands to which NK cells harboring receptors encoded by the nucleic acid and amino acid sequences bind, (iv) enhanced homing to tumor or infected sites, (v) reduced off target cytotoxic effects, (vi) enhanced secretion of immunostimulatory cytokines and chemokines (including, but not limited to IFNg, TNFa, IL-22, Perforin, CCL3, CCL4, and CCL5), (vii) enhanced ability to stimulate further innate and adaptive immune responses, and (viii) combinations thereof.

Example 6—Anti-CD70 CAR Screening and Characterization

Several in vitro experimental examples are provided herein to characterize and validate cytotoxic ability of the anti-CD70 CAR constructs expressed by CD70-deficient NK cells.

As shown in FIGS. 51A-51B, NK cells from one donor (denoted donor 451) were transduced to express anti-CD70 CARs and gene edited to reduce expression of CD70. Constructs NK77.55, NK77.58, NK77.65, NK77.71, and NK77.73 were tested, though (as throughout the disclosure, unless otherwise indicated) any of the CD70 CARs disclosed herein may be used, depending on the embodiment. Flow cytometry plots detecting the anti-CD70 CAR (by allophycocyanin (APC)-conjugated anti-FLAG antibody) and loss of CD70 expression (by phycoerythrin (PE)-conjugated anti-CD70 antibody) shows variability among tested CAR constructs expressed by NK cell populations (FIG. 51A). Clones with higher transduction efficiencies (e.g. NK77.58 and NK77.71) exhibited greater killing of CD70+ NK cells (i.e. where the CD70 knockout was unsuccessful or incomplete), resulting in the low abundance of CD70+ cells in the plots (FIG. 51B). NK8 refers to a control construct expressing GFP instead of a CAR/mbIL15.

As shown in FIGS. 52A-52D, NK from another donor (denoted donor 454) were transduced to express anti-CD70 CARs and gene edited to lose expression of CD70. Constructs NK77.55, NK77.58, NK77.65, NK77.71, and NK77.73 were tested, with no transduction and NK71 construct as controls. Flow cytometry plots detecting the anti-CD70 CAR (APC-anti-FLAG) and loss of CD70 expression (PE-anti-CD70) shows robust expression of the anti-CD70 CARs and virtually no CD70+ cells (FIG. 52A). High frequency of CAR transduction and low CD70+ abundance suggests that the transduced NK cells killed off any remaining CD70+ cells where the CD70 knockout was either unsuccessful or incomplete (FIG. 52B). Measurement of the raw mean fluorescence intensity (MFI) suggests that while transduction efficiency was high, relative expression levels per cell for each CAR may vary (FIG. 52C). CAR NK cells of this set were subjected to a cytotoxicity assay against 786-O cancer cells at varying effector:target (E:T) ratios and the $EC_{50}$ was calculated. The NK71 CAR was used as a control. Each tested CAR resulted in $EC_{50}$ ranging from about 0.25 E:T or lower, indicating that these CAR NK cells were effective in clearing co-cultured tumor cells.

As shown in FIGS. 53A-53F, the CAR NK cells from donor 454 (seen in FIG. 52) were subjected to cytotoxicity assays. As provided above, anti-CD70 CARs NK77.55, NK77.58, NK77.65, NK77.71, and NK77.73 were tested, with NK71 as a control. Cytotoxicity was tested at E:T ratios of 1:2 (FIGS. 53A-53C), 1:4 (FIGS. 53D-53E), and 1:8 (FIG. 53F). For the 1:2 ratio condition, the NK cells were re-challenged with additional tumor cells at day 7, and cytotoxicity was continued to be measured until day 10 (FIG. 53C). Each of the tested anti-CD70 CAR constructs resulted in increased cytotoxicity of the 786-O cells relative to the negative control. Constructs NK77.58 and NK77.71 consistently had the greatest relative cytotoxicity over the other CARs and the positive control CAR NK71.

As shown in FIGS. 54A-54D, the CAR NK cells from donor 454 (seen in FIGS. 52, 53) or similarly transduced to NK92 (an immortalized NK cell-like cell line) were subjected to additional cytotoxicity assays. NK cell populations with NK77.58 and NK77.71 were tested, as a non-limiting example, as they had the greatest activity as seen in FIG. 53. Cytotoxicity was tested at E:T ratios of 1:2 (FIGS. 54A-54B) or 1:4 (FIGS. 54C-54D) against either 786-O expressing GFP or ACHN cells stained with NucRed. Cytotoxicity of these two CAR constructs is consistent among the different conditions, resulting in substantial reduction of tumor cells relative to negative controls. Only the NK71 transduced to NK92 cells was found to have greater cytotoxicity compared to these two constructs.

As shown in FIGS. 55A-55M, additional anti-CD70 CARs were tested with NK cells from donor 451. CD70 knockout NK cells from donor 451 were transduced to express constructs NK77.11, NK77.16, NK77.17, NK77.31, and NK77.44, with NK71 as a positive control. Flow cytometry plots detecting the anti-CD70 CAR (APC-anti-FLAG) and loss of CD70 expression (PE-anti-CD70) shows robust expression of the CARs and negligible presence of CD70+ cells (FIG. 55A). These CAR NK cells were subjected to a cytotoxicity assay against 786-O cells at varying E:T ratios and the $EC_{50}$ was calculated (FIGS. 55B-55C). Constructs NK77.11, NK77.16, NK77.17, NK77.31, and NK77.44 had $EC_{50}$ ranging from about 0.5-0.63, which was lower than the $EC_{50}$ measured for the NK71 construct. NK77.44 resulted in an $EC_{50}$ of about 1.5, which may suggest lower cytotoxic efficacy. These CAR NK cells were further subjected to a time course cytotoxicity assay at either E:T ratios of 1:2 (FIGS. 55D-55I) or 1:4 (FIGS. 55J-55M). For longer time periods, the NK cell cultures were re-challenged with additional tumor cells (FIGS. 55G and 55M). In this case, re-challenge was at day 7, and cytotoxicity was measured until day 11. Each of the tested anti-CD70 CARs resulted in cytotoxicity relative to negative control. Construct NK77.11 performed the best overall. As suggested by the $EC_{50}$ data of FIGS. 55B-55C, NK77.44 did not perform as well as the other tested CARs. Interestingly, control CAR NK71 performed the best for earlier time points, but after re-challenge and longer culture, NK71 did not perform as well as the experimental CAR constructs, potentially suggesting improved persistence of these constructs.

As shown in FIGS. 56A-56J, the same additional anti-CD70 CARs tested in FIGS. 55A-55M were tested with NK cells from donor 454. CD70 knockout NK cells from donor 454 were transduced to express constructs NK77.11, NK77.16, NK77.17, NK77.31, and NK77.44, with NK71 as a positive control. Flow cytometry plots detecting the anti-CD70 CAR (APC-anti-FLAG) and loss of CD70 expression (PE-anti-CD70) shows robust expression of the CARs and negligible presence of CD70+ cells (FIG. 56A). These CAR NK cells were subjected to a cytotoxicity assay against 786-O cells at varying E:T ratios and the $EC_{50}$ was calculated (FIGS. 56B-56C). Consistent with what was seen with donor 451 (FIGS. 55B-55C), the $EC_{50}$ for NK77.11, NK77.16, NK77.17, and NK77.31 were generally lower than that of NK71, while NK77.44 was higher. These CAR NK cells were further subjected to a time course cytotoxicity assay at E:T ratios of 1:2 (FIGS. 56D-56E), 1:4 (FIGS. 56F-56H), or 1:8 (FIGS. 56I-56J). For the 1:2 ratio, the NK cell cultures were re-challenged with additional tumor cells at day 6 with cytotoxicity measurements until day 10 (FIG. 56E). As seen in FIG. 55, the CAR constructs resulted in cytotoxicity relative to negative control. Construct NK77.11 still generally performed well, but in some cases, construct NK77.17 resulted in even greater cytotoxicity. In the longer time period test with re-challenge, the control NK71 did not perform as well as in FIGS. 55G and 55M, with most tested CARs having greater cytotoxicity both before and after the re-challenge. This variability may be due to the NK cell donor source tested or variable CAR transduction As shown in FIGS. 57A-57H, the CAR NK cells from donor 451 (seen in FIG. 55) were subjected to additional cytotoxicity assays. All CARs tested in FIG. 55 (NK77.11, NK77.16, NK77.17, NK77.31, NK77.44) were tested. Cytotoxicity was tested at E:T ratios of 1:2 (FIGS. 57A-57E) or 1:4 (FIGS. 57F-57H) against ACHN cells. Cytotoxicity of the tested CARs is consistent with what is seen in FIG. 55.

As shown in FIGS. 58A-58H, the CAR NK cells from donor 454 (seen in FIG. 56) were subjected to additional cytotoxicity assays. All CARs tested in FIG. 56 (NK77.1, NK77.16, NK77.17, NK77.31, NK77.44) were tested. Cytotoxicity was tested at E:T ratios of 1:4 (FIGS. 58A-58E) or 1:8 (FIGS. 58F-58H) against ACHN cells. Cytotoxicity of the tested CARs is consistent with what is seen in FIG. 56.

As shown in FIGS. 59A-59D, NK cells from donor 451 were transduced to express the 10 anti-CD70 CARs shown in FIG. 50G and gene edited to lose expression of CD70. Constructs NK77.11, NK77.16, NK77.17, NK77.31, NK77.44, NK77.55, NK77.58, NK77.65, NK77.71, NK77.73 were tested, with NK71 as a positive control. These CAR constructs were also tested in the previous experiments provided in this example. Flow cytometry plots detecting the anti-CD70 CAR (APC-anti-FLAG) and loss of CD70 expression (PE-anti-CD70) shows expression of each of the 10 tested CARs and negligible presence of CD70+ cells (FIG. 59A). High frequency of CAR transduction and low CD70+ abundance suggests that the transduced NK cells killed off any remaining CD70+ cells where the CD70 knockout was either unsuccessful or incomplete (FIG. 59B). Measurement of the raw MFI suggests that while transduction efficiency was high, relative expression levels per cell for each CAR may vary (FIG. 59C). CAR NK cells were subjected to a cytotoxicity assay against 786-O cancer cells at varying E:T ratios and the $EC_{50}$ was calculated. While there is some variability in the calculated $EC_{50}$ compared to the previous experiments (such as the $EC_{50}$ for NK77.44, which appears to be competitive here but higher in FIGS. 55C and 56C), this indicates that these selected anti-CD70 CARs confer cytotoxic activity relative to negative control.

As shown in FIGS. 60A-60O, the NK cells from donor 451 as seen in FIG. 59 with the 10 anti-CD70 CARs were subjected to additional cytotoxicity assays. Cytotoxicity was tested at E:T ratios of 1:2 against 786-O (FIGS. 60A-60D), 1:2 against ACHN (FIGS. 60E-60H), 1:4 against 786-O (FIGS. 60I-60L) or 1:4 against ACHN (FIGS. 60M-60P). All of the tested CARs confer cytotoxicity compared to negative control. Based on these cytotoxicity assays, it generally appears that anti-CD70 CAR constructs NK77.11, NK77.16, NK77.17, NK77.31, NK77.58, NK77.71 have greater cytotoxicity compared to the NK71 CAR control. Conversely, NK77.55, NK77.65, and NK77.73 do not perform better than the NK71 control, and NK77.44 experiences some variability in this aspect.

As shown in FIGS. 61A-610, NK cells from another donor (denoted donor 512) were transduced to express anti-CD70 CARs and gene edited to lose expression of CD70. Flow cytometry plots show a lower percentage of NK cells expressing CD70 after transfection of CD70-directed CRISPR/Cas9 knockout constructs (FIG. 61A). All 10 CAR constructs seen in FIG. 50G (NK77.11, NK77.16, NK77.17, NK77.31, NK77.44, NK77.55, NK77.58, NK77.65, NK77.71, NK77.73) were tested, with NK71 as positive control. Flow cytometry pots show robust expression of the CAR and negligible presence of CD70+ cells (FIG. 61B). High frequency of CAR transduction and low CD70+ abundance suggests that the transduced NK cells killed off any remaining CD70+ cells where the CD70 knockout was either unsuccessful or incomplete (FIG. 61C). Measurement of the raw MFI suggests that while transduction efficiency was high, relative expression levels per cell for each CAR may vary (FIG. 61D). CAR NK cell populations with NK77.11, NK77.16, NK77.17, NK77.58, and NK77.71 were tested for persistence of the CAR over time. Over a three week period, these tested CARs were robustly maintained, while the NK71 control experienced some reduction in expression over the same length of time (FIGS. 61E-61J). In a cytotoxicity assay, the tested NK constructs NK77.11, NK77.16, NK77.17, NK77.58, and NK77.71 in donor 512 NK cells all exhibited greater cytotoxicity at E:T ratios of either 1:2 or 1:4 against 786-O cells (FIGS. 61K-61L) or ACHN cells (FIGS. 61M-61N) relative to NK71 control and negative control. These anti-CD70 CAR constructs were the ones that performed the best in the previous experiments disclosed herein.

As shown in FIGS. 62A-62B, NK cell survival is not affected by expression of anti-CD70 CAR constructs. NK cells from either donor 451 or 512 that were transduced with the anti-CD70 constructs NK77.11, NK77.16, NK77.17, NK77.58, or NK77.71 were cultured over a 5 week span and total viable cells were quantified every week. NK cells expressing the anti-CD70 CAR persisted comparably to control cells (FIGS. 62A-62B).

As shown in FIGS. 63A-63B, NK cells from donor 512 (seen in FIGS. 61 and 62) were gene edited to knockout CD70 and optionally CISH, transduced with anti-CD70 CAR constructs, and subjected to cytotoxicity assays. Constructs NK77.17, NK77.58, and NK77.71 were tested. Cytotoxicity was tested at an E:T ratio of 1:8 against either 786-O cells (FIG. 63A) or ACHN cells (FIG. 63B). Each anti-CD70 CAR construct was effective in conferring tumor cytotoxic effects to the NK cells. These data show that anti-CD70 CAR expressing cells according to several embodiments disclosed herein are effective at controlling and/or reducing tumor cell growth. According to several embodiments, gene editing of the cells expressing the anti-CD70 CAR (e.g., CISH editing) further enhances one or more aspects of the engineered cells, including but not limited to cytotoxicity and/or persistence.

Example 7—Further Screening of Anti-CD70 CARs and Related Characterization

Additional experiments were performed to further evaluate the characteristics of cells that are engineered to express anti-CD70 CARs and edited to knockout CD70 expression, and optionally are further edited in respect of one or more of the additional editing targets disclosed herein, such as CISH. Cells, as a non-limiting example, donor-derived NK cells are used, were engineered and edited as discussed herein.

Initially, NK cells engineered and edited according to embodiments disclosed herein were tracked over time in two respects—first for target binding ability of the expressed CD70 CAR over time and for the durability CD70 knockout over time—in other words, the persistence of the engineering and editing. FIG. 64A shows the data for a first donor's NK cells with respect to the ability of the CD70 CAR to bind the naturally occurring CD70 trimer. As shown, the electroporation-only control NK cells (EPNT) show essentially zero binding of the trimer (see Trimer+2nd panel in lower right of 64A). In contrast, each of non-limiting CD70 CAR construct-expressing NK cell populations showed robust binding to the trimer. This assessment was performed 1 week after transducing the cells with the CAR construct. FIG. 64B shows corresponding data from a second donor. FIG. 64C and FIG. 64D provide a table that depicts summary data for each of the CAR constructs, with the data presented as both the percentage of cells expressing a CAR that can bind the CD70 trimer (out of the entire population of CD70 cells evaluated) and also as the MFI value. Reflecting the flow cytometry scatter plots, the numerical data confirms expression of CARs capable of binding their target at one week post-transduction. FIGS. 64E and 64F show this data graphically, with CAR constructs NK77.71, 77.11 and 77.16 showing the highest ability to bind their target.

Turning to the knockout of CD70, FIG. 64G shows that, for donor one, endogenous CD70 expression is near zero for all experimental groups, as compared to the EPNT control. FIG. 64H confirms the same effect for donor two. FIGS. 64I and 64J show the numerical data for CD70 expression, both by the percentage of the total NK cell population that express CD70, as well as MFI. As shown, the CD70-edited cells expressing any of the non-limiting examples of CD70 CARs express vastly lower amounts of CD70, as compared to the unedited EPNT CD70 controls, for both donors.

FIG. 65A shows data related to the first donor's cells at two weeks post-transduction in terms of the ability of the cells to bind the native CD70 trimer. As was seen at 1-week post-transduction, the ability of the CAR-expressing cells to bind the target was significant in comparison to EPNT cells, and even in comparison to NK71-expressing cells. Similar maintenance of ability to bind is shown in FIG. 65B, for the second donor. These data are tabulated in FIGS. 65C and 65D for each donor, expressed both as the percentage of the NK cell population expresses the CAR that binds the native CD70 trimer and based on the MFI detected. FIGS. 65E and 65F graphically depict this summary data for each donor, with CAR constructs NK77.71, 77.11 and 77.16 again showing the highest ability to bind their target.

Turning to the knockout of CD70, FIG. 65G shows that, for donor one, endogenous CD70 expression is near zero for all experimental groups, as compared to the EPNT control. FIG. 65H confirms the same effect for donor two. FIGS. 651 and 65J show the numerical data for CD70 expression, both by the percentage of the total NK cell population that express CD70, as well as MFI. As shown, the CD70-edited cells expressing any of the non-limiting examples of CD70 CARs express vastly lower amounts of CD70, as compared to the unedited EPNT CD70 controls, for both donors.

FIG. 66A shows data related to the first donor's cells at three weeks post-transduction in terms of the ability of the cells to bind the native CD70 trimer. As was seen at 1-week and 2-week post-transduction, the ability of the CAR-expressing cells to bind the target was significant in comparison to EPNT cells, and even in comparison to NK71-expressing cells. Similar maintenance of ability to bind is shown in FIG. 66B, for the second donor. These data are tabulated in FIG. 66C for each donor, expressed both as the percentage of the NK cell population expresses the CAR that binds the native CD70 trimer and based on the MFI detected. FIGS. 66D and 66E graphically depict this summary data for each donor, with CAR constructs NK77.71, 77.11 and 77.16 again showing the highest ability to bind their target.

Turning to the knockout of CD70, FIG. 66F shows that, for donor one, endogenous CD70 expression is near zero for all experimental groups, as compared to the EPNT control. FIG. 66G confirms the same effect for donor two. FIGS. 66H and 661 show the numerical data for CD70 expression, both by the percentage of the total NK cell population that express CD70, as well as MFI. As shown, the CD70-edited cells expressing any of the non-limiting examples of CD70 CARs express vastly lower amounts of CD70, as compared to the unedited EPNT CD70 controls, for both donors.

FIG. 67A shows data related to the first donor's cells at four weeks post-transduction in terms of the ability of the cells to bind the native CD70 trimer. As was seen at 1-week, 2-week, and three-week post-transduction, the ability of the CAR-expressing cells to bind the target was significant in comparison to EPNT cells, and even in comparison to NK71-expressing cells. Similar maintenance of ability to bind is shown in FIG. 67B, for the second donor. These data are tabulated in FIGS. 67C and 67D for each donor, expressed both as the percentage of the NK cell population expresses the CAR that binds the native CD70 trimer and based on the MFI detected. FIGS. 67E and 67F graphically depict this summary data for each donor, with CAR constructs NK77.71, 77.11 and 77.16 again (and also 77.58) showing the highest ability to bind their target.

Turning to the knockout of CD70, FIG. 67G shows that, for donor one, endogenous CD70 expression is near zero for all experimental groups, as compared to the EPNT control. FIG. 67H confirms the same effect for donor two. FIGS. 671 and 67J show the numerical data for CD70 expression, both by the percentage of the total NK cell population that express CD70, as well as MFI. As shown, the CD70-edited cells expressing any of the non-limiting examples of CD70 CARs express vastly lower amounts of CD70, as compared to the unedited EPNT CD70 controls, for both donors.

FIG. 68A shows data related to the first donor's cells at five weeks post-transduction in terms of the ability of the cells to bind the native CD70 trimer. As was seen for weeks 1 through 4 post-transduction, the ability of the CAR-expressing cells to bind the target was significant in comparison to EPNT cells, and even in comparison to NK71-expressing cells. Similar maintenance of ability to bind is shown in FIG. 68B, for the second donor. These data are tabulated in FIGS. 68C and 68D for each donor, expressed both as the percentage of the NK cell population expresses the CAR that binds the native CD70 trimer and based on the MFI detected. FIGS. 678 and 68F graphically depict this summary data for each donor, with CAR constructs NK77.71, 77.11 and 77.16 again showing the highest ability to bind their target.

Turning to the knockout of CD70, FIG. 68G shows that, for donor one, endogenous CD70 expression is near zero for all experimental groups, as compared to the EPNT control. FIG. 68H confirms the same effect for donor two. FIG. 68I shows the numerical data for CD70 expression, both by the percentage of the total NK cell population that express CD70, as well as MFI. As shown, the CD70-edited cells expressing any of the non-limiting examples of CD70 CARs express vastly lower amounts of CD70, as compared to the unedited EPNT CD70 controls, for both donors.

FIG. 69A shows data related to the first donor's cells at seven weeks post-transduction in terms of the ability of the cells to bind the native CD70 trimer. As was seen for weeks 1 through 5 post-transduction, the ability of the CAR-expressing cells to bind the target was significant in comparison to EPNT cells, and even in comparison to NK71-expressing cells. Similar maintenance of ability to bind is shown in FIG. 69B, for the second donor. These data are tabulated in FIG. 69C for both donors, expressed both as the percentage of the NK cell population expresses the CAR that binds the native CD70 trimer and based on the MFI detected. FIGS. 69D and 69E graphically depict this summary data for each donor, with CAR constructs NK77.71, 77.11 and 77.16 again showing the highest ability to bind their target.

Turning to the knockout of CD70, FIG. 69F shows that, for donor one, endogenous CD70 expression is near zero for all experimental groups, as compared to the EPNT control. FIG. 69G confirms the same effect for donor two. FIG. 69H shows the numerical data for CD70 expression, both by the percentage of the total NK cell population that express CD70, as well as MFI. As shown, the CD70-edited cells expressing any of the non-limiting examples of CD70 CARs express vastly lower amounts of CD70, as compared to the unedited EPNT CD70 controls, for both donors.

FIGS. 70A-70B show data related to CAR expression (by MFI) over the course of the 7 weeks post-transduction for the indicated non-limiting CAR constructs. These data confirm that, as compared to controls, the selected non-limiting CAR constructs exhibited elevated CAR expression. Importantly, as in the prior figures, this is also expression of functional CARs (as shown with CD70 trimer binding). Thus, according to several embodiments, CAR constructs as disclosed herein exhibit durable expression and function over extended periods in culture. Advantageously, in several embodiments, this stable expression imparts to the cells expressing the CAR (such as an NK cell) an elongated functional life span in vivo, which, in turn, lends to the longer effective treatment of a tumor against which the CAR is directed.

Additional data characterizing cells expressing the CARs was collected. At Day 14 after inception of the cell production process (e.g., electroporation for gene editing, followed by transduction with a vector encoding a particular CAR construct), and again at day 28 after inception of the cell production process, NK cells expressing the indicated anti-CD70 CAR constructs (and also edited to knockout endogenous CD70 expression) were cocultured at the indicated E:T ratio with either 786-O tumor cells or ACHN tumor cells (experimental setup as discussed elsewhere herein). After 3 days of coculture, the culture media was assessed for concentrations of selected cytokines. FIG. 71A shows levels of interferon gamma in the media of co-cultures with 786-O (71A) or ACHN (71B) cells. As shown, the cytokine release level was elevated in the 14-day cell batches, with interferon production decreasing over time to day 28. Even at 28 days after inception of the cell production process, certain CAR constructs, such as NK77.71, still induced release of relatively elevated interferon gamma levels, particular as compared to ACHN cells also or electroporation negative controls. FIGS. 71C-71D show corresponding data for the second donor tested, with a similar overall profile of interferon gamma release, in that there was a trend to decreasing amounts of interferon production as the cells remained in culture longer, although in most groups, the degree of release was still elevated over control.

FIGS. 71E-71F show data related to detection of GM-CSF at the same time points as described above. Interestingly, the edited and engineered NK cells shows a trend towards increase GMCSF production over time, with most of the constructs tested resulting in elevated levels of GMCSF at day 28, as compared to corresponding points at day 14. There was some amount of de novo production of GMCSF from the 786-O and ACHN cells on their own, but those levels were constant over time, indicating that the GMCSF release is likely induced through the coculture with the tumor cells and reflective of the cytotoxic activation of the NK cells. FIGS. 71G-71H show corresponding data for the second donor tested, with a similar overall profile of GMCSF release.

FIGS. 71I-71J show data related to the levels of TNF alpha in the culture media from donor one after coculture as described above. In this experiment, the levels of TNF alpha generally trended up between 14 and 28 days, though certain CAR-expressing cells remained more steady between the two time points. Similar data were for donor two, at least with respect TNF alpha release during coculture with ACHN cells. The general trend for TNF alpha release in donor two was downward between the 14 and 28 day time points. In several embodiments, this may be an artifact of the overall cytokine milieu in the co-culture, in that increases, or decreases, in just one cytokine in isolation may be accounted for based on corresponding increases or decreases of other cytokines.

Similar changes in the trend of cytokine production are also shown in FIGS. 71M-71N (donor one, perforin release) and FIGS. 71O-71P (donor two, perforin release). While donor one showed a clear trend to increasing perforin release with time in culture (against both tumor cell types), donor two showed a general trend to decreased perforin release between the 14 and 28 day time points. As discussed above with respect to TNF alpha, the overall cytokine release profile is one aspect of the overall cytotoxic effects a given cell delivers, and there may be donor to donor variability in terms of what an individual batch of cells exhibits in terms of the profiles of any given cytokine in isolation.

FIGS. 71Q-71R (donor one) and 71S-71T (donor two) related to Granzyme B production at the two coculture time points. Generally, Granzyme B levels remained steady or were increased between the 14 and 28 day timepoints for both donors and with respect to both types of tumor cells. Taken together, these data demonstrate that edited and engineered immune cells, such as NK cells, retain the capacity to release cytotoxic cytokines, even after nearly 1 month in culture, indicating that the gene edits (e.g., gene knockout) are stable, the CAR expression is stable, and the CAR function is stable. Altogether, these impart to the edited and engineered cells an enhanced degree of persistence and cytotoxicity, leading to a more effective cellular immunotherapy product.

In several embodiments, more than one gene edited is made. For example, in some embodiments, an endogenous gene is knocked out that improves the survival of the edited cells, such as removing expression of a marker or protein that has overlap with a tumor marker being targets (e.g., CD70). In several embodiments, other genes are also edited. In several embodiments, CISH is edited (as discussed in more detail above). In several embodiments, multiple edits act through enhanced signaling or disrupted signaling along one or more non-redundant pathways to enhance the viability, persistence and/or cytotoxicity of the resultant immune cells. FIGS. 72A-72B show data related to the in vitro persistence of cells edited for both CD70 and CISH knockout, and expressing anti-CD70 CARs as measured by the percentage of the cell population expressing the CAR (72A) and by overall MFI detected (72B). As compared to control cells (electroporated, but not transduced with a CAR), these edited and engineered cells display enhanced persistence in culture, with notably elevated levels of CAR expression over time (week 1 timepoint is two weeks post-transduction, 20 days post-electroporation). Regardless of the method by which the expression is measured, the indicated CAR constructs were relatively stably expressed over 8 weeks in culture, demonstrating the persistence of expression. Not only is the expression stable over time, but the additional edit of CISH imparts an enhanced survival to the edited cells. FIG. 72C shows longitudinal survival data over 8 weeks of culture (assessed at 0 weeks (inception of culture), 4 weeks, and 8 weeks). As shown based on total cell count, the cells that are further edited to knock out CISH (CIS protein expression substantially or completely eliminated) show improved survival (right panels) as compared to cells edited for CD70. This is in line with several embodiments disclosed herein, in that the multiple edits add synergistic improvements to one or more characteristics of the edited cells.

Turning to the cytotoxicity of the various anti-CD70 CAR expressing cells, FIG. 72D shows cytotoxicity profiles (experimental setup discussed elsewhere herein) for the cells of one donor against 786-O tumor cells. As can be seen from the data, the addition of any CAR construct results in a dramatic reduction in the tumor cell population. The tested cells (edited CD70 and in paired groups, doubly edited for CD70 and CISH) showed a CISH-editing-dependent increase in the overall cytotoxicity at the final timepoint measured. Thus, in several embodiments, immune cells, such as NK cells, are doubly edited (or edited at a greater number of targets) for knocking out CISH and another endogenous target (here CD70 as a non-limiting example), with the CISH edit imparting an enhanced functionality (e.g., persistence and/or cytotoxicity) to the resulting cell. FIG. 72E summarizes the cytotoxicity curve data in a histogram that depicts the detection of tumor cell fluorescent signal at the final time point. CD70 edited cells are shown on the left panel while doubly edited cells (CD70 and CISH) are shown on the right. Each of the matched pairs show a reduction in the presence of tumor cells with the additional edit of CISH, indicating that CISH knockout by gene editing enhances the cytotoxicity of such edited NK cells expressing a cytotoxic CAR.

FIGS. 72F and 72G show data related to the edited cells as tested at E:T of 1:4 against ACHN or 786-O cells at day 14 after inception of the cell production process. Data are shown for the final time-point but not for the interim points (e.g., cytotoxicity curves are not shown). Corresponding data for 1:8 E:T ratios are shown in FIGS. 72H-72I. Regardless of whether the E:T is higher or lower, the data repeatedly show the editing to knock out CISH results in modest to notable further increases in the cytotoxicity of a given NK cell population edited for CD70 knockout and expression of an anti-CD70 CAR.

As was performed in several prior examples, gene edited and engineered immune cells (e.g., NK cells) were assayed in a rechallenge format, wherein the experimental cells are introduced to a new dose of tumor cells at an interim timepoint during co-culture. FIG. 72J shows rechallenge data for ACHN cells at a 1:4 E:T while 72K shows the corresponding data for 786-O cells (at day 14 after inception of the cell production process). Consistent with the data just described above, the additional edit of CISH resulted in modest to notable increases in the cytotoxicity (as measured by remaining tumor cell signal at the final timepoint). FIGS. 72L and 72M show corresponding data for 1:8 E:T ratios for each target tumor cell type. At the lower effector cell ratio, the reduction in tumor cell numbers over the first portion of the experiment was consistent, but tumor cells trended to increases in numbers after re-challenge. However, despite this trend, within an experimental pair, again, the CISH knockout editing resulted in relatively consistent enhancements in cytotoxicity.

Additional cytotoxicity analyses were performed at longer time points, in particular day 21 and day 28 after inception of the cell production process to edit CD70 and either edited for CISH, or not, followed by transduction with the indicated non-limiting CAR constructs. A rechallenge format was used here as well. Summarized data are presented both for time-points just prior to rechallenge as well as for the final time point (cytotoxicity curves are not shown). FIGS. 72A and 73B show data for the indicated CD70-CAR constructs expressed by NK cells (initial co-culture at 21 days after inception of the cell production process) and the cytotoxic effects against 786-O cells as measured after 72 hours of co-culture at either 1:4 (73A) or 1:8 (73B) E:T ratio. While discerning notable differences across all constructs is difficult in those that yielded the most significant cytotoxicity, positive impact of CISH editing can be seen in those with less robust cytotoxicity (noting that all CD70 CAR expressing cells were significantly more effective than control cells. For example the NK77.17 construct exhibited a decrease in the signal detected between the non-edited population ($1^{st}$ histogram bar in 73A) and the CISH edited population ($5^{th}$ histogram bar in 73A. At a reduced effector cell concentration (73B) a general stable to downward trend in signal detection (indicative of increased cytotoxicity) was observed.

FIGS. 73C and 73D show the corresponding data collected 6 days after the rechallenge. As shown at both the 1:4 and 1:8 E:T ratios the gene editing to knockout CISH resulted in notable decreases in tumor cells at either ratio tested. This increase in cytotoxicity with CISH editing is particularly notable in the rechallenge context, as fresh tumor cells were introduced, yet the edited cells were able to substantially inhibit tumor cell growth.

Figure 73H:
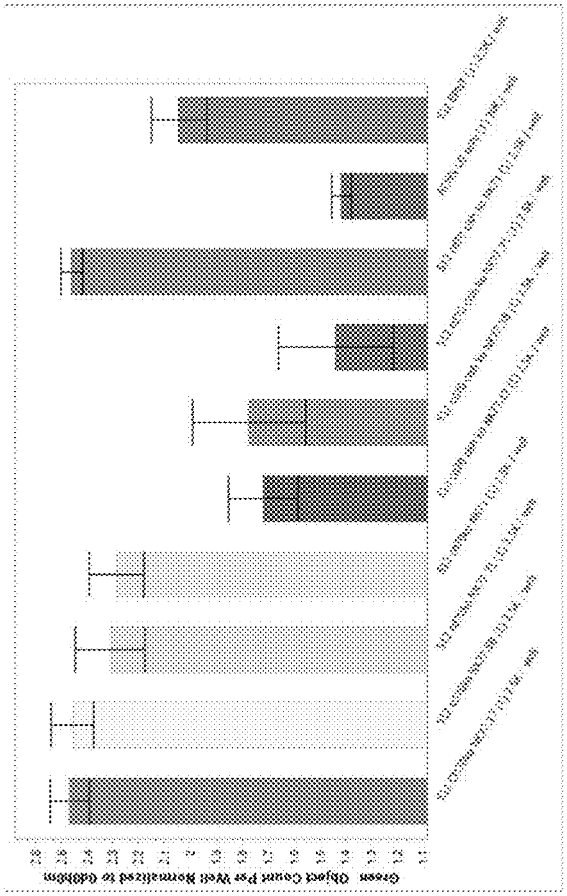

FIGS. 73E and 73F show data at 72 hours after inception of co-culture of the NK cells (edited or not) with ACHN cells (21 days after inception of the cell production process) at 1:4 (73E) or 1:8 (73F) E:T ratios. As with the 786-O cells discussed above, CISH editing did not show major changes in those construct where cytotoxicity was already quite robust. Again, NK77.17, which allowed more tumor growth than the other CAR constructs, at least in this experiment, showed a noticeable reduction in signal (enhanced cytotoxicity) with the editing to knockout CISH. At the lower, 1:8 E:T, increased cytotoxicity was seen with each of the test constructs (other than internal control NK71). FIGS. 73G and 73H show the data collected at the final time point, 6 days post-rechallenge. Seen in both the 1:4 and 1:8 E:T ratios, in each instance, CISH knockout resulted in a notable reduction in tumor burden at the final timepoint. These data, in combination with the other data discussed herein, are indicative of the positive effects of CISH editing on the persistence and cytotoxicity of the cells that are so-edited.

Moving to testing of cells at 28 days after inception of the cell production process, FIGS. 74A-74B show data for the indicated CD70 CAR-expressing NK cells against 786-O cells at 1:4 or 1:8 E:T ratios. As with day 21 cells, the highly effective nature of the NK cells at 1:4 tend to mask some of the positive CISH-editing effects, though construct 77.71 and internal control NK71 showed some further enhanced cytotoxicity with CISH editing. The impact of CISH editing was more evident at the 1:8 ratio, which saw more notable reductions in tumor cell growth with the 77.71 and NK71 constructs. At 6 days post-rechallenge, more noticeable positive effects of CISH were detected. Using a 1:4 E:T, all of the constructs tested showed either a stable pattern (77.17) or a further increase in cytotoxicity with CISH editing (77.58, 77.71, and NK71). Likewise a similar pattern was seen at the lower 1:8 E:T ratio, indicative of the enhanced effects imparted by CISH editing.

FIGS. 74E and 74F show corresponding data prior to rechallenge with ACHN cells. Each of the non-limiting constructs tested showed robust cytotoxicity at 1:4 E:T, though CISH editing did further enhance cytotoxicity in the NK771.71 and NK71 constructs. At 1:8 E:T, the editing of CISH recapitulated the enhanced cytotoxicity in those two constructs, with the other two holding relatively steady. After rechallenge similar patterns were noted. In this non-limiting experiment, CISH editing enhanced the cytotoxicity of two constructs both before and after rechallenge, which is in line with several embodiments disclosed herein. In some embodiments, the combination of CD70 editing and CISH edited, with expression of an anti-CD70 CAR results in significantly enhanced persistence and/or cytotoxicity of the cells so edited and engineered.

FIGS. 75A and 75B show data related to the Indel (insertions or deletions) frequency as measured in the bulk population that was edited with respect to CISH (75A) or CD70 (75B). These data show that random Indel frequency is low and that editing of CISH results in a much higher detection of Indels in the region of DNA anticipated to be edited based on the complementary guide RNA. With respect to CD70, edits are detected in both the CISH edited and non-CISH edited cell populations, as both are edited with respect to CD70. An uptick in Indel frequency is seen with the additional CISH editing, which, in some embodiments, is related to CISH editing inducing an increased number of CD70 editing events. However, in several embodiments, the impact of CISH editing is not directly impacting CD70 editing events, but rather a result of the double-edited cells being enriched over time after the editing and transduction with the CD70 CAR. In other words, a cell edited for CISH would have increased cytotoxicity (as seen with the data above) and a cell edited for CD70 would be more robustly protected from fratricide due to the CD70 CAR expression. Thus, the double knockout cells are enriched in the population over time as compared to those not edited for CD70, which would be reduced as a result of CD70 CAR-based fratricide. Regardless, in several embodiments, the double editing provide multiple benefits (enhanced viability, persistence and/or cytotoxicity) to the edited and engineered cells.

Assessing CD70 editing is a relatively straightforward undertaking, as endogenous CD70 is expressed on the surface of NK cells. Thus, flow cytometry or other such can be used to detect degree of successful editing of CD70 in a population of cells. As a mechanism to analyze the impacts of editing for CISH, which is an intracellular protein, a surrogate approach was assessed. FIG. 75C depicts a schematic representation of CISH signaling. Since CISH encoded CIS protein, which acts as a negative regulator of STAT5/JAK signaling, the knockout of CISH would disinhibit this pathway, resulting in an increase in Stat5 phosphorylation, which could then be detected, for example, by Western blotting or intracellular staining followed by flow cytometry. By way of example, FIG. 75D shows a Western blot for phosphorylated Stats5, using protein isolated from cells expressing the NK77.71 CAR construct, edited for CD70, expressing a CD70 CAR and either not edited for CISH, or edited for CISH (denoted by the "CISH" indicator). FIGS. 75E and 75F show two sets of normalized data. 75E shows data normalized to the intensity of the band on the Western that corresponds to the electroporated control signal (EP). 75F shows data normalized to the EP control, but set as a value of 1. With either analysis, these data show that editing CISH results in an increase in the phosphorylated Stat5. Thus, in several embodiments, edited cells for CISH are further analyzed for the degree of pStat5 present, as a surrogate for direct assessment of CISH on a genomic level.

It is contemplated that various combinations or subcombinations of the specific features and aspects of the embodiments disclosed above may be made and still fall within one or more of the inventions. Further, the disclosure herein of any particular feature, aspect, method, property, characteristic, quality, attribute, element, or the like in connection with an embodiment can be used in all other embodiments set forth herein. Accordingly, it should be understood that various features and aspects of the disclosed embodiments can be combined with or substituted for one another in order to form varying modes of the disclosed inventions. Thus, it is intended that the scope of the present inventions herein disclosed should not be limited by the particular disclosed embodiments described above. Moreover, while the invention is susceptible to various modifications, and alternative forms, specific examples thereof have been shown in the drawings and are herein described in detail. It should be understood, however, that the invention is not to be limited to the particular forms or methods disclosed, but to the contrary, the invention is to cover all modifications, equivalents, and alternatives falling within the spirit and scope of the various embodiments described and the appended claims. Any methods disclosed herein need not be performed in the order recited. The methods disclosed herein include certain actions taken by a practitioner; however, they can also include any third-party instruction of those actions, either expressly or by implication. In addition, where features or aspects of the disclosure are described in terms of Markush groups, those skilled in the art will recognize that the disclosure is also thereby described in terms of any individual member or subgroup of members of the Markush group.

The ranges disclosed herein also encompass any and all overlap, sub-ranges, and combinations thereof. Language such as "up to," "at least," "greater than," "less than," "between," and the like includes the number recited. Numbers preceded by a term such as "about" or "approximately" include the recited numbers. For example, "about 90%" includes "90%." In some embodiments, at least 95% sequence identity or homology includes 96%, 97%, 98%, 99%, and 100% sequence identity or homology to the reference sequence. In addition, when a sequence is disclosed as "comprising" a nucleotide or amino acid sequence, such a reference shall also include, unless otherwise indicated, that the sequence "comprises", "consists of" or "consists essentially of" the recited sequence. Any titles or subheadings used herein are for organization purposes and should not be used to limit the scope of embodiments disclosed herein.

All references cited herein, including but not limited to published and unpublished applications, patents, and literature references, are incorporated herein by reference in their entirety and are hereby made a part of this specification. To the extent publications and patents or patent applications incorporated by reference contradict the disclosure contained in the specification, the specification is intended to supersede and/or take precedence over any such contradictory material.

SEQUENCES

In several embodiments, there are provided amino acid sequences that correspond to any of the nucleic acids disclosed herein (and/or included in the accompanying sequence listing), while accounting for degeneracy of the nucleic acid code. Furthermore, those sequences (whether nucleic acid or amino acid) that vary from those expressly disclosed herein (and/or included in the accompanying sequence listing), but have functional similarity or equivalency are also contemplated within the scope of the present disclosure. The foregoing includes mutants, truncations, substitutions, codon optimization, or other types of modifications.

In accordance with some embodiments described herein, any of the sequences may be used, or a truncated or mutated form of any of the sequences disclosed herein (and/or included in the accompanying sequence listing) may be used and in any combination.

SEQUENCE LISTING (1214 sequences)

SEQ ID NO: 1 - DNA, 135 bp, Homo sapiens
  misc_feature: CD8alpha hinge - DNA
accacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgat

SEQ ID NO: 2 - protein, 45 aa, Homo sapiens
  MISC_FEATURE: CD8a hinge - protein
TTTPAPRPPTPAPTIASQPLSLRPEACRPAAGGAVHTRGLDFACD

SEQ ID NO: 3 - DNA, 63 bp, Homo sapiens
  misc_feature: CD8 TM - DNA
atctacatctgggcgcccttggccgggacttgtggggtccttctcctgtcactggttatcacc

SEQ ID NO: 4 - protein, 21 aa, Homo sapiens
  MISC_FEATURE: CD8 TM - protein
IYIWAPLAGTCGVLLLSLVIT

SEQ ID NO: 5 - DNA, 111 bp, Homo sapiens
  misc_feature: OX40 - DNA
cggagggaccagaggctgccccccgatgcccacaagccccctgggggaggcagtttccggacccccatccaagaggagcaggccgacgcccactccaccctggccaagatc

SEQ ID NO: 6 - protein, 37 aa, Homo sapiens
  MISC_FEATURE: OX40 - protein
RRDQRLPPDAHKPPGGGSFRTPIQEEQADAHSTLAKI

SEQ ID NO: 7 - DNA, 336 bp, Homo sapiens
  misc_feature: CD3zeta - DNA
agagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 8 - protein, 112 aa, Homo sapiens
  MISC_FEATURE: CD3zeta - protein
RVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 9 - DNA, 63 bp, Homo sapiens
  misc_feature: T2A - DNA
ggctctggcgagggaaggggttccctgcttacttgcggcgacgtcgaagagaatcccggtccg

SEQ ID NO: 10 - protein, 21 aa, Homo sapiens
  MISC_FEATURE: T2A - protein
GSGEGRGSLLTCGDVEENPGP

SEQ ID NO: 11 - DNA, 342 bp, Homo sapiens
  misc_feature: Homo sapiens native IL15 - DNA
aactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtcc

SEQ ID NO: 12 - protein, 114 aa, Homo sapiens
  MISC_FEATURE: Homo sapiens native IL15 - protein
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 13 - DNA, 207 bp, Homo sapiens
  misc_feature: CD8hinge/TM - DNA
actaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgc

SEQ ID NO: 14 - protein, 66 aa, Homo sapiens
  MISC_FEATURE: CD8hinge/TM - protein
TTTPAPRPPTPAPTIASQPLSLRPEACRPAAGGAVHTRGLDFACDIYIWAPLAGTCGVLLLSLVIT

SEQ ID NO: 15 - DNA, 30 bp, Homo sapiens
  misc_feature: Linker 1 (used after FLAG tag)  - DNA
ggcggtggtggctctggtggtggcggcagc

SEQ ID NO: 16 - protein, 10 aa, Homo sapiens
  MISC_FEATURE: Linker 1 (used after FLAG tag)  - protein
GGGGSGGGGS

SEQ ID NO: 17 - DNA, 30 bp, Homo sapiens
  misc_feature: Linker 2 - after neg. control binding domain - DNA
ggccaggccggctccggaggaggaggatcc

SEQ ID NO: 18 - protein, 10 aa, Homo sapiens
  MISC_FEATURE: Linker 2 - after neg. control binding domain - Protein
GQAGSGGGGS

SEQ ID NO: 19 - DNA, 12 bp, Homo sapiens
  misc_feature: Linker post scFv - DNA
ggccaggccggc

SEQ ID NO: 20 - protein, 4 aa, Homo sapiens
  MISC_FEATURE: Linker post scFv - protein
GQAG

SEQ ID NO: 21 - DNA, 33 bp, Homo sapiens
  misc_feature: Misc Linker - DNA
ggcggcggcggtagcggtggtggcggctccgga

SEQ ID NO: 22 - protein, 11 aa, Homo sapiens
  MISC_FEATURE: Misc Linker - protein
GGGGSGGGGSG

SEQ ID NO: 23 - DNA, 18 bp, Homo sapiens
  misc_feature: Linker - DNA
ggccaggccggctccgga

SEQ ID NO: 24 - protein, 6 aa, Homo sapiens
  MISC_FEATURE: Linker - protein
GQAGSG

SEQ ID NO: 25 - DNA, 405 bp, Homo sapiens
  misc_feature: NKG2D Extracellular Fragment - DNA
ttattcaaccaagaagttcaaattcccttgaccgaaagttactgtggcccatgtcctaaaaactggatatgttacaaaaataactgctaccaattttttgatgagagtaaaaactggtatgagagccaggcttcttgtatgtctcaaaatgccagccttctgaaagtatacagcaaagaggaccaggatttacttaaactggtgaagtcatatcattggatgggactagtacacattccaacaaatggatcttggcagtgggaagatggctccattctctcacccaacctactaacaataattgaaatgcagaagggagactgtgcactctatgcctcgagctttaaaggctatatagaaaactgttcaactccaaatacgtacatctgcatgcaaaggactgtg

SEQ ID NO: 26 - protein, 135 aa, Homo sapiens
  MISC_FEATURE: NKG2D Extracellular Fragment - protein
LFNQEVQIPLTESYCGPCPKNWICYKNNCYQFFDESKNWYESQASCMSQNASLLKVYSKEDQDLLKLVKSYHWMGLVHIPTNGSWQWEDGSILSPNLLTIIEMQKGDCALYASSFKGYIENCSTPNTYICMQRTV

SEQ ID NO: 27 - DNA, 645 bp, Homo sapiens
  misc_feature: Full Human NKG2D - DNA
gggtggattcgtggtcggaggtctcgacacagctgggagatgagtgaatttcataattataacttggatctgaagaagagtgatttttcaacacgatggcaaaagcaaagatgtccagtagtcaaaagcaaatgtagagaaaatgcatctccattttttttctgctgcttcatcgctgtagccatgggaatccgtttcattattatggtaacaatatggagtgctgtattcctaaactcattattcaaccaagaagttcaaattcccttgaccgaaagttactgtggcccatgtcctaaaaactggatatgttacaaaaataactgctaccaattttttgatgagagtaaaaactggtatgagagccaggcttcttgtatgtctcaaaatgccagccttctgaaagtatacagcaaagaggaccaggatttacttaaactggtgaagtcatatcattggatgggactagtacacattccaacaaatggatcttggcagtgggaagatggctccattctctcacccaacctactaacaataattgaaatgcagaagggagactgtgcactctatgcctcgagctttaaaggctatatagaaaactgttcaactccaaatacgtacatctgcatgcaaaggactgtg

SEQ ID NO: 28 - DNA, 405 bp, Homo sapiens
  misc_feature: Codon optimized human NKG2D fragment - DNA
ctgttcaatcaggaagtccagatccccctgacagagtcttactgcggcccatgtcccaagaactggatctgctacaagaacaattgttatcagttctttgacgagagcaagaactggtatgagtcccaggcctcttgcatgagccagaatgcctctctgctgaaggtgtacagcaaggaggaccaggatctgctgaagctggtgaagtcctatcactggatgggcctggtgcacatccctacaaacggctcttggcagtgggaggacggctccatcctgtctccaaatctgctgaccatcatcgagatgcagaagggcgattgcgccctgtacgccagctccttcaagggctatatcgagaactgctccacacccaatacctacatctgtatgcagaggaccgtg

SEQ ID NO: 29 - DNA, 126 bp, Homo sapiens
  misc_feature: 4-1BB
aaacggggcagaaagaaactcctgtatatattcaaacaaccatttatgagaccagtacaaactactcaagaggaagatggctgtagctgccgatttccagaagaagaagaaggaggatgtgaactg

SEQ ID NO: 30 - protein, 29 aa, Homo sapiens
  MISC_FEATURE: Amino Acid Sequence CD28 Transmembrane domain
FWVLVVVGGVLACYSLLVTVAFIIFWVRS

SEQ ID NO: 31 - protein, 39 aa, Homo sapiens
  MISC_FEATURE: Amino Acid Sequence CD28 IC domain
KRSRLLHSDYMNMTPRRPGPTRKHYQPYAPPRDFAAYRS

SEQ ID NO: 32 - DNA, 1122 bp, Artificial Sequence
  NKG2D-Ox40-CD3z (without mbIL15)
atggccttaccagtgaccgccttgctcctgccgctggccttgctgctccacgccgccaggccgttattcaaccaagaagttcaaattcccttgaccgaaagttactgtggcccatgtcctaaaaactggatatgttacaaaaataactgctaccaattttttgatgagagtaaaaactggtatgagagccaggcttcttgtatgtctcaaaatgccagccttctgaaagtatacagcaaagaggaccaggatttacttaaactggtgaagtcatatcattggatgggactagtacacattccaacaaatggatcttggcagtgggaagatggctccattctctcacccaacctactaacaataattgaaatgcagaagggagactgtgcactctatgcctcgagctttaaaggctatatagaaaactgttcaactccaaatacgtacatctgcatgcaaaggactgtgaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 33 - protein, 374 aa, Artificial Sequence
  NKG2D-CD8a hinge/tm-OX40-CD3z (NKX101)
MALPVTALLLPLALLLHAARPLFNQEVQIPLTESYCGPCPKNWICYKNNCYQFFDESKNWYESQASCMSQNASLLKVYSKEDQDLLKLVKSYHWMGLVHIPTNGSWQWEDGSILSPNLLTIIEMQKGDCALYASSFKGYIENCSTPNTYICMQRTVTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 34 - DNA, 2150 bp, Artificial Sequence
  NK19H-NF-2 -NKX019 (includes T2A and mbIL15)
gaattcgccgccaccatggccttaccagtgaccgccttgctcctgccgctggccttgctgctccacgccgccaggccggatattcagatgacccagagcccgagcagcctgagcgcgagcgtgggcgatcgcgtgaccattacctgccgcgcgagccaggatattagcaaatatctgaactggtatcagcagaaaccgggcggcaccgtgaaactgctgatttatcataccagccgcctgcatagcggcgtgccgagccgctttagcggcagcggcagcggcaccgattttaccctgaccattagcagcctgcagccggaagatattgcgacctatttttgccagcagggcaacaccctgccgtatacctttggcggcggcaccaaactggaaattaccggtggcggtggctcgggcggtggtgggtcgggtggcggcggatctcaggtgcagctgcaggaaagcggcccgggcctggtgaaaccgagccagaccctgagcctgacctgcaccgtgagcggcgtgagcctgccggattatggcgtgagctggattcgccagccgccgggcaaaggcctggaatggattggcgtgatttggggcagcgaaaccacctattataacagcgcgctgaaaagccgcctgaccattagcaaagataacagcaaaaaccaggtgagcctgaaactgagcagcgtgaccgcggcggataccgcggtgtattattgcgcgaaacattattattatggcggcagctatgcgatggattattggggccagggcaccagcgtgaccgtgagcagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaagcggccgcgtcgac

SEQ ID NO: 35 - protein, 706 aa, Artificial Sequence
  NK19H-NF-2
MALPVTALLLPLALLLHAARPDIQMTQSPSSLSASVGDRVTITCRASQDISKYLNWYQQKPGGTVKLLIYHTSRLHSGVPSRFSGSGSGTDFTLTISSLQPEDIATYFCQQGNTLPYTFGGGTKLEITGGGGSGGGGSGGGGSQVQLQESGPGLVKPSQTLSLTCTVSGVSLPDYGVSWIRQPPGKGLEWIGVIWGSETTYYNSALKSRLTISKDNSKNQVSLKLSSVTAADTAVYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 36 - DNA, 735 bp, Artificial Sequence
  NK71 anti-CD70 scFv
caggtcaccttgaaggagtctggtcctgtgctggtgaaacccacagagaccctcacgctgacctgcaccgtctctgggttctcactcagtaatgctagaatgggtgtgacctggatccgtcagcccccagggaaggccctggagtggcttgcacacattttttcgaatgacgaaaaatcctacagtacatctctgaagagcaggctcaccatctccaaggacacttccaaaacccaggtggtccttaccatgaccaacatggaccctgtggacacagccacatattactgtgcacggatacgagattactatgacattagtagttattatgactactggggccagggaaccctggtcagcgtctcctcaggcggtggtggctctggtggtggcggcagcggcggtggtggctctgacatccagatgacccagtctccatctgccatgtctgcatctgtaggagacagagtcaccatcacttgtcgggcgagtcaggacattagcaattatttagcctggtttcagcagaaaccagggaaagtccctaagcgcctgatctatgctgcatccagtttgcaaagtggggtcccatcaaggttcagcggcagtggatcggggacagagttcactctcacaatcagcagcctgctgcctgaagattttgcaacttattactgtctacagcttaatagtttcccgttcacttttggcggagggaccaaggtggagatcaac

SEQ ID NO: 37 - DNA, 750 bp, Artificial Sequence
  NK72 anti-CD70 scFv
gaagtgcagcttgtccagagcggagccgaagtgaagaagcctggcgagagcctgaagatcagctgcaagggctcaggttacggattcacaagttattggataggttgggtgcgccagatgcctggtaagggactggaatggatgggtatcattcatcccgatgatagcgacaccaaatacagcccaagctttcagggccaggtcacaatcagcgctgacaagagcatcagcaccgcctaccttcagtggtcgtctctgaaggccagcgacaccgcaatgtactactgtgcctctagctatttgcgtggcttgtggggaggctattttgactattggggccaaggtacactggtcaccgtcagcagcggcggtggtggctctggtggtggcggcagcggcggtggtggctctgagctccagagcgtgctgacccagcctcctagcgcaagcggcacccctggacagcgtgtgacaattagctgtagcggatcaagctcaaacattggctcaaattatgtgaattggtatcagcaattgcccggtacagcacccaaactgctcatttatggagattatcaacgacctagcggagtgcctgatcgttttagcggtagcaaaagcggcaccagcgcatcactggcaatttcaggcctgcgtagcgaagatgaggcggattattactgtgctacccgcgacgattcgttatctgggtctgtcgtttttggcaccggtacaaaactgaccgtgctg

SEQ ID NO: 38 - DNA, 720 bp, Artificial Sequence
  NK77.1_CD70_DB01_C03 scFv
caggtgcagctggtgcagtctggggctgaggtgaagaagcctggggcctcagtgaaggtctcctgcaaggcttctggatacaccttcaccggccattatttgcactgggtgcgacaggcccctggacaagggcttgagtggatgggatggatcaaccctaacagtggtggcacaaactatgcacagaagtttcagggcagggtcaccatgaccagggacacgtccactagcacagtgtacatggagctgagcagcctgagatctgaggacacggccgtgtattactgtgttagaggaagcggttggtatgacctggactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccgggcaagtcagaatattggcacatatttagcttggtatcagcagaaaccagggaaagcccctaagctcctgatctatgacgcatccaacttggagactggggtcccatcaaggttcagtggcagtggatctgggacagatttcactctcaccatcagcagtctgcaacctgaagattttgcaacttactactgtcaacagagttacagaatccctctcaccttcggccaagggacacgactggagattaaa

SEQ ID NO: 39 - DNA, 723 bp, Artificial Sequence
  NK77.2_CD70_DB01_D02 scFv
caggtgcagctggtgcagtctggggctgaggtgaagaagcctggggcctcagtgaaggtttcctgcaaggcatctggatacaccttcaccaactactatatgcactgggtgcgacaggcccctggacaagggcttgagtggatgggaataatcaaccctagtggtgggagcacaagctacgcacagaagttccagggcagagtcaccatgaccagggacacgtccacgagcacagtctacatggagctgagcagcctgagatctgaggacacggccgtgtattactgtgctagagaactaggagtcgccgggtacttcgatctctggggccgtggcaccctggtcactgtctcctcaggtggaggcggttcaggcggaggtggctctggcggtggcggatcggacatccagatgacccagtctccatcctccctgtctgcatctgtaggagacagagtcaccatcacttgccgggcgagtcagaggattagcaattggttagcctggtatcagcagaaaccagggaaagcccctaagctcctgatctatgatgcatccaacttggaaaccggggtcccatccaggttcagtggcagtggatctgggacggattttactctcaccatcagcagcctgcagcctgaagattttgcaacttattactgtcaacagacctatagtcctccccctacttttggccaggggaccaagctggagatcaaa

SEQ ID NO: 40 - DNA, 750 bp, Artificial Sequence
  NK77.3_CD70_DB01_E06 scFv
caggtgcagctggtgcagtctggggctgaggtgaagaagcctggggcctcagtgaaggtttcctgcaaggcatctggatacaccttcaccggttactatatccactgggtgcgacaggcccctggacaagggcttgagtggatgggaataatcaaccctagtggtggaagcacaagctacgcacagaagttccagggcagagtcaccatgaccagggacacgtccacgagcacagtctacatggagctgagcagcctgagatctgaggacacggccgtgtattactgtgctagagacctgtcagggatcgacggatatattggtttctttgactactggggccaagggaccctggtcaccgtctcctcaggtggaggcggttcaggcggaggtggctctggcggtggcggatcggatattgtgatgactcagtctccactctccctgcccgtcacccctggagagccggcctccatctcctgcaggtctagtcagagcctcctgcactctaacggatacaactatttggattggtacctgcagaagccagggcagtctccacagctcctgatctatgcagcctcttcattacaatccggggtccctgacaggttcagtggcagtggatcaggcacagattttacactgaaaatcagcagagtggaggctgaggatgttggggtttattactgcatgcaagctctacaaactcctatcaccttcggccaagggacacgactggagattaaa

SEQ ID NO: 41 - DNA, 723 bp, Artificial Sequence
  NK77.4_CD70_DB01_G04 scFv
caggtgcagctggtgcagtctggggctgaggtgaagaagcctggggcctcagtgaaggtttcctgcaaggcatctggaggaaccttcagaagccatgtcatatcctgggtgcgacaggcccctggacaagggcttgagtggatgggaataatcgatcctagtggtggcagcacaagctacgcacagaggttccagggcagagtcaccatgaccagggacacgtccacgagcacagtctacatggagctgagcagcctgagatctgaggacacggccgtgtattactgtgctaaagattacactgggctgcttggaatggatgtctggggccaagggacaaccgtcaccgtctcttcaggtggaggcggttcaggcggaggtggctctggcggtggcggatcggacatccagatgacccagtctccatcctccctgtctgcatctgtaggagacagagtcaccatcacttgccgggcaagtcaggacattgacacctatttagcctggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacacaacccctttcacgttcggccaagggaccaaggtggaaatcaaa

SEQ ID NO: 42 - DNA, 723 bp, Artificial Sequence
  NK77.5_CD70_DB01_G05 scFv
caggtgcagctggtgcagtctggggctgaggtgaagaagcctggggcctcagtgaaggtctcctgcaaggcttctggatacaccttcatcgactattatatccattgggtgcgacaggcccctggacaagggcttgagtggatgggatggatgaaccccaacagtggtaacacaggctatgcacagaagttccagggcagagtcaccatgaccagggacacctccacaagcacagtctacatggagctgagcagcctgagatctgaggacacggccgtgtattactgtgcgagaggcctttccggctacgacttggacgactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccaggcaagtcaggacattagcaactatttaaattggtatcagcagaaaccagggaaagcccctaagctcctgatctatgatgcatccagtttggaaagtggggtcccatcaaggttcagtggcagtggatctgggacagatttcactctcaccatcagcagtctgcaacctgaagattttgcaacttactactgtcaacagagttaccgatcacctctcactttcggcggagggaccaaggtggagatcaaa

SEQ ID NO: 43 - DNA, 720 bp, Artificial Sequence
  NK77.6_CD70_DB01_G07 scFv
caggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggatggatcaacccgaacagtggtggcacaaaatacgcacataagttccagggcagagtcaccatgaccagggacacgtccacgagcacagtctacatggagctgagcagcctgagatctgaggacacggccgtgtattactgtgctagaggactgtcaggttacgattttgactactggggccaagggaccacagtcaccgtctcctcaggtggaggcggttcaggcggaggtggctctggcggtggcggatcggacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttgaccatcagcagcctgcagcctgaagattttgcaacatattactgtcaacaggcttataggtggcctatcaccttcggccaagggacacgactggagattaaa

SEQ ID NO: 44 - DNA, 723 bp, Artificial Sequence
  NK77.7_CD70_DB01_G11 scFv
caggtgcagctggtgcagtctggggctgaggtgaagaagcctggggcctcagtgaaggtttcctgcaaggcatctggatacaccttcaccggctactatatgcactgggtgcgacaggcccctggacaagggcttgagtggatgggatggatgaaccctaatagtggtaacacaggctacgcacagaagttccagggcagagtcaccatgaccagggacacgtccacgagcacagtctacatggagctgagcagcctgagatctgaggacacggccgtgtattactgtgctagagggaccgacgtgtatggagactttgactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgatgcatcctacttggaaacaggggtcccatcaaggttcagtggcagtggatctgggacagatttcactctcaccatcagcagtctgcaacctgaagattttgcaacttactactgtcaacagagttacacaattcctcctacgttcggccaagggaccaaggtggaaatcaaa

SEQ ID NO: 45 - DNA, 744 bp, Artificial Sequence
  NK77.9_CD70_DB02_A03 scFv
caggtgcagctggtgcagtctggggctgaggtgaagaagcctgggtcctcggtgaaggtctcctgcaaggcttctggatacaccttcacagagaacgaaatgcattgggtgcgacaggcccctggacaagggcttgagtggatgggaggcatcatccctatctttggtacagcaaactacgcacagaagttccagggcagagtcacgattaccgcggacgaatccacgagcacagcctacatggagctgagcagcctgagatctgaggacacggccgtgtattactgtgcgagagagggaggaaccgccatggccaccggttattactactatgggatggacgtgtggggccaagggaccaccgtcaccgtctcctcaggtggaggcggttcaggcggaggtggctctggcggtggcggatcggacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactctcaccatcagcagcctgcagcctgaagattttgcaacatattactgtcaacagagctattccacccctctcactttcggccaggggaccaaggtggagatcaaa

SEQ ID NO: 46 - DNA, 738 bp, Artificial Sequence
  NK77.10_CD70_DB02_A04 scFv
caggtgcagctggtgcagtctggggctgaggtgaagaagcctggggcctcagtgaaggtttcctgcaaggcatctggatacaccttcaccgagaatgaaatgcactgggtgcgacaggcccctggacaagggcttgagtggatgggatggatcaactctaatggtggctacacagggtacgcactgaagttccagggcagagtcaccatgaccagggacacgtccacgagcacagtctacatggagctgagcagcctgagatctgaggacacggccgtgtattactgtgctagagccagtaattacggaggacactttgactactggggccaagggaccctggtcaccgtctcctcaggtggaggcggttcaggcggaggtggctctggcggtggcggatcggatattgtgatgactcagtctccactctccctgcccgtcacccctggagagccggcctccatctcctgcaggtctagtcagagcctcctgcattccaacggatacaactatttggattggtacctgcagaagccagggcagtctccacagctcctgatctatcaggcatctagcctggagtccggggtccctgacaggttcagtggcagtggatcaggcacagattttacactgaaaatcagcagagtggaggctgaggatgttggggtttattactgcatgcaaggaacgcactggcctccaactttcggcggagggaccaaggtggagatcaaa

SEQ ID NO: 47 - DNA, 723 bp, Artificial Sequence
  NK77.11_CD70_DB02_A05 scFv
caggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggcagcacaatatacgcacagaagttccagggcagagtcaccatgaccagggacacgtccacgagcacagtctacatggagctgagcagcctgagatctgaggacacggccgtgtattactgtgctaaagacatgggagcgtgggcagctggttttgactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccaagcaagtcaggacattagcaactatttaaattggtatcagcagaaaccagggaaagcccctaagctcctgatctatgctacctccaccttggctaacggggtcccatcaaggttcagtggcagtggatctgggacagatttcactctcaccatcagcagtctgcaacctgaagattttgcaacttactactgtcaacagagttacagtacgcttaccttcggccaagggacacgactggagattaaa

SEQ ID NO: 48 - DNA, 726 bp, Artificial Sequence
  NK77.12_CD70_DB02_A06 scFv
caggtgcagctggtgcagtctggggctgaggtgaagaagcctggggcctcagtgaaggtttcctgcaaggcatctggatacaccttcaccgggtactatatgcactgggtgcgacaggcccctggacaagggcttgagtggatgggatggatcaacccaaatagtggtgatacagggtacgcacagaagttccagggcagagtcaccatgaccagggacacgtccacgagcacagtctacatggagctgagcagcctgagatctgaggacacggccgtgtattactgtgctagatccgtcaacgactacggtgattacgacggttactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactctgaccatcagcagcctgcagcctgaagattttgcaacatattactgtcaacagtcttacagtacgcctcctacgttcggccaagggaccaaggtggaaatcaaa

SEQ ID NO: 49 - DNA, 726 bp, Artificial Sequence
  NK77.13_CD70_DB02_A07 scFv
caggtgcagctggtgcagtctggggctgaggtgaagaagcctggggcctcagtgaaggtttcctgcaaggcatctggatacaccttcaccggatactatatgcactgggtgcgacaggcccctggacaagggcttgagtggatgggaataatcaaccctagtggtgggagcacaagctacgcacagaagttccagggcagagtcaccatgaccagggacacgtccacgagcacagtctacatggagctgagcagcctgagatctgaggacacggccgtgtattactgtgctagagattacggtgattatgacgcctcgtttgactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccgggcaagtcagagcattgacaattggttagcgtggtatcagcagaaaccagggaaagcccctaagctcctgatctatgctgcatccacattgcaaagtggggtcccatcaaggttcagtggcagtggatctgggacagatttcactctcaccatcagcagtctgcaacctgaagattttgcaacttactactgtcaacagagttacgatagtcctcccacttttggccaggggaccaagctggagatcaaa

SEQ ID NO: 50 - DNA, 717 bp, Artificial Sequence
  NK77.14_CD70_DB02_A08 scFv
caggtgcagctggtgcagtctggggctgaggtgaagaagcctggggcctcagtgaaggtttcctgcaaggcatctggatacaccttcaccagctacgatatcaattgggtgcgacaggcccctggacaagggcttgagtggatgggaataatcaacccctccgatggtagcacaatctacgcacagaacttccagggcagagtcaccatgaccagggacacgtccacgagcacagtctacatggagctgagcagcctgagatctgaggacacggccgtgtattactgtgtgaaggaagaggcctggtacttcgatctctggggccgtggcaccctggtcactgtctcctcaggtggaggcggttcaggcggaggtggctctggcggtggcggatcggacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttgaccatcagcagcctgcagcctgaagattttgcaacatattactgtcaacagtcctatagcacccctctcactttcggcggagggaccaaggtggagatcaaa

SEQ ID NO: 51 - DNA, 717 bp, Artificial Sequence
  NK77.15_CD70_DB02_A09 scFv
caggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggatggatgaaccctgataacggtgatacagggtacgcacagatgttccagggcagagtcaccatgaccagggacacgtccacgagcacagtctacatggagctgagcagcctgagatctgaggacacggccgtgtattactgtgcttcaggggattactatgacatcttgtactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgtgtccaatttggaaacaggggtcccatcaaggttcagtggaagtggatctgggacagattttactctcaccatcagcagcctgcagcctgaagattttgcaacatattactgtcaacaggctaattccttccctctcactttcggcggagggaccaaggtggagatcaaa

SEQ ID NO: 52 - DNA, 720 bp, Artificial Sequence
  NK77.16_CD70_DB02_A11 scFv
caggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggatggatgaaccccaacagtggtgatacaggatacgcacagaagttccagggcagagtcaccatgaccagggacacgtccacgagcacagtctacatggagctgagcagcctgagatctgaggacacggccgtgtattactgtgctagagggcccagcgggtacgaatttgactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccgggcaagtcagaccattagcaattatttaaattggtatcagcagaaaccagggaaagcccctaagctcctgatctatgacgcatccagtttggaaagtggggtcccatcaaggttcagtggcagtggatctgggacagatttcactctcaccatcagcagtctgcaacctgaagattttgcaacttactactgtcaacaggcaatcagttttcctctcactttcggcggagggaccaaggtggagatcaaa

SEQ ID NO: 53 - DNA, 732 bp, Artificial Sequence
  NK77.17_CD70_DB02_B06 scFv
caggtgcagctggtgcagtctggggctgaggtgaagaagcctggggcctcagtgaaggtttcctgcaaggcatctggatacaccttcaccgattactatatgcactgggtgcgacaggcccctggacaagggcttgagtggatgggaataatcaaccctaatagtggtggaacaaattacgcacagaagttccagggcagagtcaccatgaccagggacacgtccacgagcacagtctacatggagctgagcagcctgagatctgaggacacggccgtgtattactgtgctagagattttagtgtgtatgctgctgcagatggcatggatgtctggggccaagggacattggtcaccgtctcttcaggtggaggcggttcaggcggaggtggctctggcggtggcggatcggacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgacgcatccaatttggccaccggggtcccatcaaggttcagtggcagtggatctgggacagatttcactctcaccatcagcagtctgcaacctgaagattttgcaacttactactgtcaacagagtgatagttcacctctcactttcggccaagggaccaaggtggagatcaaa

SEQ ID NO: 54 - DNA, 729 bp, Artificial Sequence
  NK77.18_CD70_DB02_B09 scFv
caggtgcagctggtgcagtctggggctgaggtgaagaagcctggggcctcagtgaaggtttcctgcaaggcatctggatacaccttcaccgggtactatatgcactgggtgcgacaggcccctggacaagggcttgagtggatgggaataatcaaccctggggatggcggtacaatctacgcacagaatttccagggcagagtcaccatgaccagggacacgtccacgagcacagtctacatggagctgagcagcctgagatctgaggacacggccgtgtattactgtgctagaggattcggcgagtcagcccccgatgcttttgatatctggggccaagggacaatggtcaccgtctcttcaggtggaggcggttcaggcggaggtggctctggcggtggcggatcggacatccagatgacccagtctccatcctccctgtctgcatctgtaggagacagagtcaccatcacttgccaggcaagtcaggacattagcaattatttaaattggtatcagcagaaaccagggaaagcccctaagctcctgatctatggtgcaacgacattgcaaagtggggtcccatcaaggttcagtggcagtggatctgggacagatttcactctcaccatcagcagtctgcaacctgaagattttgcaacttactactgtcaacaggcggatagttttccttacacttttggccaggggaccaagctggagatcaaa

SEQ ID NO: 55 - DNA, 720 bp, Artificial Sequence
  NK77.19_CD70_DB02_C03 scFv
caggtgcagctggtgcagtctggggctgaggtgaagaagcctggggcctcagtgaaggtttcctgcaaggcatctggatacaccttcaccggttactatatgcactgggtgcgacaggcccctggacaagggcttgagtggatgggaataatcaaccctagtggtgggagcacaagctacgcacagaagttccagggcagagtcaccatgaccagggacacgtccacgagcacagtctacatggagctgagcagcctgagatctgaggacacggccgtgtattactgtgctgccgggacagagatctactacatggacgtctggggcaaagggaccacggtcaccgtctcctcaggtggaggcggttcaggcggaggtggctctggcggtggcggatcggacatccagatgacccagtctccatcctccctgtctgcatctgtaggagacagagtcaccatcacttgcagggcgagtcagactattgacatctatttaaattggtatcagcagaaaccagggaaagcccctaagctcctgatctacgatgcatccaatttggaaacaggggtcccatcaaggttcagtggaagtggatctgggacagattttactttgaccatcagcagcctgcagcctgaagattttgcaacatattactgtcaacaggcagattccttccctctcactttcggcggagggaccaaggtggagatcaaa

SEQ ID NO: 56 - DNA, 747 bp, Artificial Sequence
  NK77.20_CD70_DB02_C04 scFv
caagtgcagttagttcagtcaggcgccgaagttaaaaaacccggagcgagcgtaaaagtgtcttgtaaagccagtggcggcacatttagctcttatgcgatatcatgggttcgccaagcaccaggccagggcctggaatggatggggatgataaatccaagtgatggcgccactacttacgcacagaagttccagggcagagtcaccatgaccagggacacgtccacgagcacagtctacatggagctgagcagcctgagatctgaggacacggccgtgtattactgtgctagagagagggagctactacatttcgccacaaattattactactatggtatggacgtgtggggccaagggaccaccgtcaccgtctcctcaggtggaggcggttcaggcggaggtggctctggcggtggcggatcggacatccagatgacccagtctccatcttctctgtctgcatctgtaggagacagagtcaccatcacttgtcgggcgagtcagggtattagcaacaacttaaattggtatcagcagaaaccagggaaagcccctaagctcctgatctatgctgcatccagtttgcacagtggggtcccatcaaggttcagcggcagtggatctgggacagatttcactctcactatcagcagcctgcagcctgaagattttgcaacttactattgtcaacaggctgatgctttccctctcactttcggcggagggaccaaggtggagatcaaa

SEQ ID NO: 57 - DNA, 735 bp, Artificial Sequence
  NK77.22_CD70_DB02_C07 scFv
caggtgcagctggtgcagtctggggctgaggtgaagaagcctggggcctcagtgaaggtttcctgcaaggcatctggatacaccttcacccggaactatatgcactgggtgcgacaggcccctggacaagggcttgagtggatgggatggatctctcctgacaatggtgttacaaattacgcacagaatttccagggcagagtcaccatgaccagggacacgtccacgagcacagtctacatggagctgagcagcctgagatctgaggacacggccgtgtattactgtgctaagacacaaggctcatccagctggtatcagtggtacttcgatctctggggccgtggcaccctggtcactgtctcctcaggtggaggcggttcaggcggaggtggctctggcggtggcggatcggacatccagatgacccagtctccatcctccctgtctgcatctgtaggagacagagtcaccatcacttgccgggcaagtcagagcattggaacctggttagcctggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacaccacccctattacgttcggccaagggaccaaggtggaaatcaaa

SEQ ID NO: 58 - DNA, 723 bp, Artificial Sequence
  NK77.24_CD70_DB02_D02 scFv
caggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcgatccagggagtggtgacacaagctacgcacagaagttccagggcagagtcaccatgaccagggacacgtccacgagcacagtctacatggagctgagcagcctgagatctgaggacacggccgtgtattactgtgctagagggtccaactggtacgactactttgactactggggccaagggaccctggtcaccgtctcctcaggtggaggcggttcaggcggaggtggctctggcggtggcggatcggaaatagtgatgacgcagtctccagccaccctgtctgtgtctccaggggaaagagccaccctctcctgcagggccagtcagagtgttagcagctacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtatgatagctatcctccaactttcggcggagggaccaaggtggagatcaaa

SEQ ID NO: 59 - DNA, 723 bp, Artificial Sequence
  NK77.25_CD70_DB02_D04 scFv
caggtgcagctggtgcagtctggggctgaggtgaagaagcctggggcctcagtgaaggtttcctgcaaggcatctggataccgcctgagcgaccattatatgcactgggtgcgacaggcccctggacaagggcttgagtggatgggaataatcaaccctagtggtgggagcacaacatacgcacagaacttccagggcagagtcaccatgaccagggacacgtccacgagcacagtctacatggagctgagcagcctgagatctgaggacacggccgtgtattactgtgcttccagttactatggtgactacgtcttggtgaattggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccaggcaagtcaggacattagcaattatttaaattggtatcagcagaaaccagggaaagcccctaagctcctgatctatgctgcatccaccttggaaagtggggtcccatcaaggttcagtggcagtggatctgggacagatttcactctcaccatcagcagtctgcaacctgaagattttgcaacttactactgtcttcaggattacgactaccctctgacttttggccaggggaccaagctggagatcaaa

SEQ ID NO: 60 - DNA, 726 bp, Artificial Sequence
  NK77.26_CD70_DB02_D10 scFv
caggtgcagctggtgcagtctggggctgaggtgaagaagcctggggcctcagtgaaggtttcctgcaaggcatctggatacaccttcaccgattactatgtccactgggtgcgacaggcccctggacaagggcttgagtggatgggatggatcaacccgaatactggtgggacaagcttcgcacagaatttccagggcagagtcaccatgaccagggacacgtccacgagcacagtctacatggagctgagcagcctgagatctgaggacacggccgtgtattactgtgctagagatctgggtcaatggttgggagagattgactactggggccaagggaccctggtcaccgtctcctcaggtggaggcggttcaggcggaggtggctctggcggtggcggatcggacatccagatgacccagtctccatcttctctctctgcatctgtaggagacagagtcaccatcacttgtcgggcgagtcagacaatttataagtggttagcctggtatcagcagaaaccagggaaagcccctaagctcctgatctatgacgcatccagtttggaaagtggggtcccatcaaggttcagcggcagtggatctgggacagatttcactctcactatcagcagcctgcagcctgaagattttgcaacttactattgtcaacaggctaacagtttccctttcactttcggccctgggaccaaagtggatatcaaa

SEQ ID NO: 61 - DNA, 738 bp, Artificial Sequence
  NK77.27_CD70_DB02_D11 scFv
caggtgcagctggtgcagtctggggctgaggtgaagaagcctggggcctcagtgaaggtttcctgcaaggcatctggatacaccttcaccgactacaccgattactttgtgcactgggtgcgacaggcccctggacaagggcttgagtggatgggaatattcaaccctagtgatggtagcacaagctacgcacaggaattccagggcagagtcaccatgaccagggacacgtccacgagcacagtctacatggagctgagcagcctgagatctgaggacacggccgtgtattactgtgctagaggaccttacagtagtagctggtattactttgactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactctgaccatcagcagcctgcagcctgaagatttcgcaacatattactgtcaacaggcccactcgtttcctcccacgttcggccaagggaccaaggtggaaatcaaa

SEQ ID NO: 62 - DNA, 726 bp, Artificial Sequence
  NK77.28_CD70_DB02_E04 scFv
caggtgcagctggtgcagtctggggctgaggtgaagaagcctggggcctcagtgaaggtttcctgcaaggcatctggatacatcttcaccgattactatatgcactgggtgcgacaggcccctggacaagggcttgagtggatgggaataatcaaccctagtggtggagatacactttacgcacagaagttccagggcagagtcaccatgaccagggacacgtccacgagcacagtctacatggagctgagcagcctgagatctgaggacacggccgtgtattactgtgctagagaaggcgtaggagctatgggcgtgtttgactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccgggcaagtaccagcattagcgattatgtgcattggtatcagcagaaaccagggaaagcccctaagctcctgatctatgatgcatccagtttgcaaagtggggtcccatcaaggttcagtggcagtggatctgggacagatttcactctcaccatcagcagtctgcaacctgaagattttgcaacttactactgtcaacagagtgatagtacccctcccactttcggcggagggaccaaggtggagatcaaa

SEQ ID NO: 63 - DNA, 732 bp, Artificial Sequence
  NK77.29_CD70_DB02_F06 scFv
caggtgcagctggtgcagtctggggctgaggtgaagaagcctggggcctcagtgaaggtttcctgcaaggcatctggatacaccttcaccgatcactatatccactgggtgcgacaggcccctggacaagggcttgagtggatgggatggatcagtgcgtacaatggtaaaacaaattacgcacagaagttccagggcagagtcaccatgaccagggacacgtccacgagcacagtctacatggagctgagcagcctgagatctgaggacacggccgtgtattactgtgctagagacacaatctactatgacttttggagtgggtacgactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccgggcaagtcagggaattagcaataatttaaattggtatcagcagaaaccagggaaagcccctaagctcctgatctattacgcatccaccttgcaaagtggggtcccatcaaggttcagtggcagtggatctgggacagatttcactctcaccatcagcagtctgcaacctgaagattttgcaacttactactgtcaacagagttacagtacccctatcaccttcggccaagggacacgactggagattaaa

SEQ ID NO: 64 - DNA, 732 bp, Artificial Sequence
  NK77.31_CD70_DB02_F08 scFv
caggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggcgcgacaatctacgcacagaagttccagggcagagtcaccatgaccagggacacgtccacgagcacagtctacatggagctgagcagcctgagatctgaggacacggccgtgtattactgtgctagatctcgcggtgactactatggaagcggggattttgactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccgggcaagtcagacgattagcaattatttaaattggtatcagcagaaaccagggaaagcccctaagctcctgatctatgatgcatccacgttggaagccggggtcccatcaaggttcagtggcagtggatctgggacagatttcactctcaccatcagcagtctgcaacctgaagattttgcaacttactactgtcaacagagttacaaccctccatacacttttggccaggggaccaagctggagatcaaa

SEQ ID NO: 65 - DNA, 720 bp, Artificial Sequence
  NK77.32_CD70_DB02_G07 scFv
caggtgcagctggtgcagtctggggctgaggtgaagaagcctggggcctcagtgaaggtttcctgcaaggcatctggatacaccttcaccgattactatatgcactgggtgcgacaggcccctggacaagggcttgagtggatgggaataatcaaccctagtggtggaagcacaagctacgcacagaagttccagggcagagtcaccatgaccagggacacgtccacgagcacagtctacatggagctgagcagcctgagatctgaggacacggccgtgtattactgtgctagaggatattttgatcacgcattcgatatctggggccaagggacaatggtcaccgtctcttcaggtggaggcggttcaggcggaggtggctctggcggtggcggatcggacatccagatgacccagtctccatcctccctgtctgcatctgtaggagacagagtcaccatcacttgccgggcaagtcagagcattagcacttatttaaattggtatcagcagaaaccagggaaagcccctaagctcctgatctatgatgcatccaacttggagatcggggtcccatcaaggttcagtggcagtggatctgggacagatttcactctcaccatcagcagtctgcaacctgaagattttgcaacttactactgtcaacagagtgacagttcaccactcactttcggccaggggaccaaggtggagatcaaa

SEQ ID NO: 66 - DNA, 738 bp, Artificial Sequence
  NK77.33_CD70_DB02_H04 scFv
caggtgcagctggtgcagtctggggctgaggtgaagaagcctggggcctcagtgaaggtttcctgcaaggcatctggatacaccttcaccggttactatatgcactgggtgcgacaggcccctggacaagggcttgagtggatgggaataatcaaccctagtggtggggatacaatatacgcacagaagttccagggcagagtcaccatgaccagggacacgtccacgagcacagtctacatggagctgagcagcctgagatctgaggacacggccgtgtattactgtgctagaggtgactcgtcttcatggtacgactattactactacatggacgtctggggcaaagggaccacggtcaccgtctcctcaggtggaggcggttcaggcggaggtggctctggcggtggcggatcggacatccagatgacccagtctccatcctccctgtctgcatctgtaggagacagagtcaccatcacttgccaagcaagtcaggatattagcaactatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttaccggacccctctcactttcggcggagggaccaaggtggagatcaaa

SEQ ID NO: 67 - DNA, 723 bp, Artificial Sequence
  NK77.34_CD70_DB02_H05 scFv
caggtgcagctggtgcagtctggggctgaggtgaagaagcctggggcctcagtgaaggtttcctgcaaggcatctggatacaccttcaccgactactttacccactgggtgcgacaggcccctggacaagggcttgagtggatgggatggatcaacacatatgacggtaatacaaattacgcacagaagttccagggcagagtcaccatgaccagggacacgtccacgagcacagtctacatggagctgagcagcctgagatctgaggacacggccgtgtattactgtgctagagaaatggagtggctcggccaggtggactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccgggcaagtcaggatattcgcaacgatttagggtggtatcagcagaaaccagggaaagcccctaagctcctgatctatgctgcatccaacttggagaccggggtcccatcaaggttcagtggcagtggatctgggacagatttcactctcaccatcagcagtctgcaacctgaagattttgcaacttactactgtcaacagagttacagtgcacctttcactttcggccctgggaccaaagtggatatcaaa

SEQ ID NO: 68 - DNA, 723 bp, Artificial Sequence
  NK77.35_CD70_DB02_H08 scFv
caggtgcagctggtgcagtctggggctgaggtgaagaagcctggggcctcagtgaaggtttcctgcaaggcatctggatacaccttcaccagctactatatacactgggtgcgacaggcccctggacaagggcttgagtggatgggacgaatcaaccctaatggtggagggacaaactacgcacagaagttccagggcagagtcaccatgaccagggacacgtccacgagcacagtctacatggagctgagcagcctgagatctgaggacacggccgtgtattactgtgctagaggccacagagggggtggcgggattgactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccgggcaagtcaggagattagcaactatttagcctggtatcagcagaaaccagggaaagcccctaagctcctgatctatgatgcatccaacttgcaaactggggtcccatcaaggttcagtggcagtggatctgggacagatttcactctcaccatcagcagtctgcaacctgaagattttgcaacttactactgtcaacagagttacagtacccctttcactttcggccctgggaccaaagtggatatcaaa

SEQ ID NO: 69 - DNA, 723 bp, Artificial Sequence
  NK77.36_CD70_DB03_A06 scFv
caggtgcagctggtgcagtctggggctgaggtgaagaagcctggggcctcagtgaaggtttcctgcaaggcatctggaggtaccttcagtagctacgcaatttcatgggtgcgacaggcccctggacaagggcttgagtggatgggatggatctctcccaacagtggtgacacacactacgcacagaagttccagggcagagtcaccatgaccagggacacgtccacgagcacagtctacatggagctgagcagcctgagatctgaggacacggccgtgtattactgtgctagagactgggggtcaggctggtacgtggactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccaggcaagtcaggacattagcgattctttaaattggtatcagcagaaaccagggaaagcccctaagctcctgatctattccgcatccagtttgcaaagtggggtcccatcaaggttcagtggcagtggatctgggacagatttcactctcaccatcagcagtctgcaacctgaagattttgcaacttactactgtcaacagagttttacaaccccttatacgttcggccaagggaccaaggtggaaatcaaa

SEQ ID NO: 70 - DNA, 723 bp, Artificial Sequence
  NK77.37_CD70_DB03_A07 scFv
caggtgcagctggtgcagtctggggctgaggtgaagaagcctgggtcctcggtgaaggtctcctgcaaggcttctggaggcaccttcaatagctatggaatcagctgggtgcgacaggcccctggacaagggcttgagtggatgggaggtatcatccctatctttggtacagcaaactacgcacagaagttccagggcagagtcacgattaccgcggacgaatccacgagcacagcctacatggagctgagcagcctgagatctgaggacacggccgtgtattactgtgcgagagatacctacggggatgacgcttttgatatctggggccaagggacaatggtcaccgtctcttcaggtggaggcggttcaggcggaggtggctctggcggtggcggatcggacatccagatgacccagtctccatcttctctgtctgcatctgtaggagacagagtcaccatcacttgtcgggcgagtcagtctattagcagctggttagcctggtatcagcagaaaccagggaaagcccctaagctcctgatctatgatgcatccaatttggaaacaggggtcccatcaaggttcagcggcagtggatctgggacagatttcactctcactatcagcagcctgcagcctgaagattttgcaacttactattgtcaacagaatttcagtcctcctctcaccttcggccaagggacacgactggagattaaa

SEQ ID NO: 71 - DNA, 738 bp, Artificial Sequence
  NK77.38_CD70_DB03_A08 scFv
caggtgcagctggtgcagtctggggctgaggtgaagaagcctggggcctcagtgaaggtttcctgcaaggcatctggatacagtttcaccagctactatatgcactgggtgcgacaggcccctggacaagggcttgagtggatgggaataatcaaccctagtggtgggactacaagctacgcacagaagttccagggcagagtcaccatgaccagggacacgtccacgagcacagtctacatggagctgagcagcctgagatctgaggacacggccgtgtattactgtgctagagacaattccccgtatagctcaagctggtgggactactttgactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccgggcaagtcaggacattcggcattatttagcatggtatcagcagaaaccagggaaagcccctaagctcctgatctatgacgcatccagtttgcaaagtggggtcccatcaaggttcagtggcagtggatctgggacagatttcactctcaccatcagcagtctgcaacctgaagattttgcaacttactactgtcaacagacctacgacgcacctatcaccttcggccaagggacacgactggagattaaa

SEQ ID NO: 72 - DNA, 732 bp, Artificial Sequence
  NK77.39_CD70_DB03_A09 scFv
caggtgcagctggtgcagtctggggctgaggtgaagaagcctggggcctcagtgaaggtttcctgcaaggcatctggatacaccttcaccgattactatattcactgggtgcgacaggcccctggacaagggcttgagtggatgggatggatcaccccgaacagtggttatacatattacgcacagaatttccagggcagagtcaccatgaccagggacacgtccacgagcacagtctacatggagctgagcagcctgagatctgaggacacggccgtgtattactgtgctagaaacacagactgttatggggacttcctggggctggatgtctggggccaagggacaacggtcaccgtctcttcaggtggaggcggttcaggcggaggtggctctggcggtggcggatcggacatcgtgatgacccagtctccagactccctggctgtgtctctgggcgagagggccaccatcaactgccgggccagctctagtatttccaactacttagcttggtaccagcagaaaccaggacagcctcctaagctgctcatttacggcgcatctacccgggcttccggggtccctgaccgattcagtggcagcgggtctgggacagatttcactctcaccatcagcagcctgcaggctgaagatgtggcagtttattactgtcagcaaagctatagtactcctctcactttcggccaggggaccaaggtggagatcaaa

SEQ ID NO: 73 - DNA, 732 bp, Artificial Sequence
  NK77.40_CD70_DB03_A11 scFv
caggtgcagctggtgcagtctggggctgaggtgaagaagcctggggcctcagtgaaggtttcctgcaaggcatctggatacaccttcaacggctaccttatgcactgggtgcgacaggcccctggacaagggcttgagtggatgggaatagttaacccttccgatggtagcacaggctacgcacagaagttccagggcagagtcaccatgaccagggacacgtccacgagcacagtctacatggagctgagcagcctgagatctgaggacacggccgtgtattactgtgcgaaggacacaggactccgctactttgactggctacttgactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccgggcgagtcagggcattaccaattttttagcctggtatcagcagaaaccagggaaagcccctaagctcctgatatatgatgcatccaacttggaaaccggggtcccatccaggttcagtggcagtggatctgggacggatttcactctcaccatcagcagcctgcagcctgaagattttgcaacttattactgtcaacagagctatggggcccctcttaccttcggccaagggacacgactggagattaaa

SEQ ID NO: 74 - DNA, 720 bp, Artificial Sequence
  NK77.41_CD70_DB03_A12 scFv
caggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcgatcctagtggtggccgaacaatttacgcacagcgcttccagggcagagtcaccatgaccagggacacgtccacgagcacagtctacatggagctgagcagcctgagatctgaggacacggccgtgtattactgtgctagacacgaagcaggcggaatctttgactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccaagcaagtcaggacattagcaactatttaaattggtatcagcagaaaccagggaaagcccctaagctcctgatctattccgcatccaccttgcaaagtggggtcccatcaaggttcagtggcagtggatctgggacagatttcactctcaccatcagcagtctgcaacctgaagattttgcaacttactactgtcaacagagttacagttctccttatagattcggccaagggaccaaggtggaaatcaaa

SEQ ID NO: 75 - DNA, 744 bp, Artificial Sequence
  NK77.42_CD70_DB03_B01 scFv
caggtccagctggtgcagtctggggctgaggtgaagaagcctgggtcctcagtgaaggtctcctgcaaggcttctggatataccttcagcgactcctacatgcattgggtgcgacaggcccctggacaagggcttgagtgggtcggagggatcatccctatggcaggtatacccgcctacgcagaggaattccagggcagagtcacgattaccgcggacgagtccacgagcacagcctacatggagctgagcagcctgagatctgaggacacggccgtgtattactgtgcgagagccgacgattatgggggaaattggtacttcgatctctggggccgtggcaccctggtcactgtctcctcaggtggaggcggttcaggcggaggtggctctggcggtggcggatcggatattgtgatgactcagtctccactctccctgcccgtcacccctggagagccggcctccatctcctgcaggtctagtcagagcctcctccactctaatggctacaactatttggattggtacctgcagaagccagggcagtctccacagctcctgatctatgcagcttctagtctccagtccggggtccctgacaggttcagtggcagtggatcaggcacagattttacactgaaaatcagcagagtggaggctgaggatgttggggtttattactgcatgcaaggggcccattggcctccgacttttggccaggggaccaagctggagatcaaa

SEQ ID NO: 76 - DNA, 726 bp, Artificial Sequence
  NK77.43_CD70_DB03_B04 scFv
caggtgcagctggtgcagtctggggctgaggtgaagaagcctggggcctcagtgaaggtttcctgcaaggcatctggatacatcttcaccgactactatatgcactgggtgcgacaggcccctggacaagggcttgagtggatgggaataatcaaccctagtggtggcagcacaagctacgcacagaagttccagggcagagtcaccatgaccagggacacgtccacgagcacagtctacatggagctgagcagcctgagatctgaggacacggccgtgtattactgtgctagagactcaggatggtatgagtcctggttcgacccctggggccagggaaccctggtcaccgtctcctcaggtggaggcggttcaggcggaggtggctctggcggtggcggatcggacatccagatgacccagtctccatcctccctgtctgcatctgtaggagacagagtcaccatcacttgccgggcaagtcaggacattagggatgggttaggctggtatcagcagaaaccagggaaagcccctaagctcctgatctatgctgcatccactttgcaaagtggggtcccatcaaggttcagtggcagtggatctgggacagatttcactctcaccatcagcagtctgcaacctgaagattttgcaacttactactgtcaacagagttacgggacccctcctacgttcggccaagggaccaaggtggaaatcaaa

SEQ ID NO: 77 - DNA, 729 bp, Artificial Sequence
  NK77.44_CD70_DB03_B06 scFv
caggtgcagctggtgcagtctggggctgaggtgaagaagcctggggcctcagtgaaggtttcctgcaaggcatctggatacaccttcaccgactactatcttcactgggtgcgacaggcccctggacaagggcttgagtggatgggatggatcagcgcctacaatggtaacacaaattacgcacagaagttccagggcagagtcaccatgaccagggacacgtccacgagcacagtctacatggagctgagcagcctgagatctgaggacacggccgtgtattactgtgctagagagattgtgggtgctacagaagattggtacttcgatctctggggccgtggcaccctggtcactgtctcctcaggtggaggcggttcaggcggaggtggctctggcggtggcggatcggaaatagtgatgacgcagtctccagccaccctgtctgtgtctccaggggaaagagccaccctctcctgcagggccagtcagagtgttagcagctatttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtatgattcctcccctacgttcggccaagggaccaaggtggaaatcaaa

SEQ ID NO: 78 - DNA, 723 bp, Artificial Sequence
  NK77.45_CD70_DB03_B09 scFv
caggtgcagctggtgcagtctggggctgaggtgaagaagcctggggcctcagtgaaggtttcctgcaaggcatctggatacaccttcaccgcctactatctgcactgggtgcgacaggcccctggacaagggcttgagtggatgggaatgatcaaccccaacaatggtggcacaatttacgcacagacattccagggcagagtcaccatgaccagggacacgtccacgagcacagtctacatggagctgagcagcctgagatctgaggacacggccgtgtattactgtgctagagacctgggcggctacgtcctgtttgactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgatgcatccaacttggaaaccggggtcccatcaaggttcagtggcagtggatctgggacagatttcactctcaccatcagcagtctgcaacctgaagattttgcaacttactactgtcaacagagtcacagtgcgcctatcaccttcggccaagggacacgactggagattaaa

SEQ ID NO: 79 - DNA, 723 bp, Artificial Sequence
  NK77.46_CD70_DB03_C05 scFv
caggtgcagctggtgcagtctggggctgaggtgaagaagcctggggcctcagtgaaggtttcctgcaaggcatctggatacaccttcaccgactactatattcactgggtgcgacaggcccctggacaagggcttgagtggatgggaatgatcaaccctagaggaggtagcacaacttacgcacagtcattccagggcagagtcaccatgaccagggacacgtccacgagcacagtctacatggagctgagcagcctgagatctgaggacacggccgtgtattactgtgctagagatttaggtgactatggggactacgactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccgggcaagtcagagcattagcacaaacttagcttggtatcagcagaaaccagggaaagcccctaagctcctgatctatgatgcatcctatttggaggctggggtcccatcaaggttcagtggcagtggatctgggacagatttcactctcaccatcagcagtctgcaacctgaagattttgcaacttactactgtcaacagagttacagtacccctccgacttttggccaggggaccaagctggagatcaaa

SEQ ID NO: 80 - DNA, 756 bp, Artificial Sequence
  NK77.47_CD70_DB03_D11 scFv
gaggtgcagctgttggagtctgggggaggcttggtacagcctggggggtccctgagactctcctgtgcagcctctggattcacctttagcaattcagatatgaattgggtccgccaggctccagggaaggggctggagtgggtctcagctattagtggtggaggtgacacactctactacgcagactccgtgaagggccggttcaccatctccagagacaattccaagaacacgctgtatctgcaaatgaacagcctgagagccgaggacacggccgtatattactgtgcgatggccagcgctttggacagtagcggtgacaatgaggcttttgatatctggggccaagggacaacagtcaccgtctcttcaggtggaggcggttcaggcggaggtggctctggcggtggcggatcggacatcgtgatgacccagtctccagactccctggctgtgtctctgggcgagagggccaccatcaactgcaagtccagccagagtgttttatattccagtaataacaagaactacttagcttggtaccagcagaaaccaggacagcctcctaagctgctcatttactgggcatctacccgggattccggggtccctgaccgattcagtggcagcgggtctgggacagatttcactctcaccatcagcagcctgcaggctgaagatgtggcagtttattactgtcagcaatattatggcttccctcccaccttcggccaagggacacgactggagattaaa

SEQ ID NO: 81 - DNA, 732 bp, Artificial Sequence
  NK77.48_CD70_DB03_E01 scFv
caggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggatggatcaacccaaataacggtggtacaagctacgcacagaagttccagggcagagtcaccatgaccagggacacgtccacgagcacagtctacatggagctgagcagcctgagatctgaggacacggccgtgtattactgtgctagagtggaggacgatttctggagcggccctagctttgactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccaagcaagtcacgacattagcaaattcttaaattggtatcagcagaaaccagggaaagcccctaagctcctgatctatgatgcatccaatttgcaacgaggggtcccatcaaggttcagtggcagtggatctgggacagatttcactctcaccatcagcagtctgcaacctgaagattttgcaacttactactgtcaacagacctacagtttccctttcacttttggccaggggaccaagctggagatcaaa

SEQ ID NO: 82 - DNA, 738 bp, Artificial Sequence
  NK77.49_CD70_DB03_E03 scFv
caggtgcagctggtgcagtctggggctgaggtgaagaagcctgggtcctcggtgaaggtctcctgcaaggcttctggaggcaccttcaccaattatgctttcagctgggtgcgacaggcccctggacaagggcttgagtggatgggaggtatcatccctatcagcggtgccgcaaactacgcacagaagttccagggcagagtcacgattaccgcggacgaatccacgagcacagcctacatggagctgagcagcctgagatctgaggacacggccgtgtattactgtgcgagagggtccggactggacgatgcttttgatatctggggccaagggacaatggtcaccgtctcttcaggtggaggcggttcaggcggaggtggctctggcggtggcggatcggatattgtgatgactcagtctccactctccctgcccgtcacccctggagagccggcctccatctcctgcaggtctagtcagagcctcctccattcaaacgggtacaactatttggattggtacctgcagaagccagggcagtctccacagctcctgatctatgatgcctcttcccttcagtccggggtccctgacaggttcagtggcagtggatcaggcacagattttacactgaaaatcagcagagtggaggctgaggatgttggggtttattactgcatgcaagctcggcaaactcctctgaccttcggccaagggacacgactggagattaaa

SEQ ID NO: 83 - DNA, 768 bp, Artificial Sequence
  NK77.50_CD70_DB03_E09 scFv
caggtgcagctggtgcagtctggggctgaggtgaagaagcctggggcctcagtgaaggtttcctgcaaggcatctggatacaccttcaccgcgtactatatgcactgggtgcgacaggcccctggacaagggcttgagtggatgggatggatgaaccccaatagtggtaacacaggatacgcacagaagttccagggcagagtcaccatgaccagggacacgtccacgagcacagtctacatggagctgagcagcctgagatctgaggacacggccgtgtattactgtgctagagagggcagaatcgattacggggactacgacgactactactattactacggtatggacgtgtggggccaagggaccactgtcaccgtctcctcaggtggaggcggttcaggcggaggtggctctggcggtggcggatcggatattgtgatgactcagtctccactctccctgcccgtcacccctggagagccggcctccatctcctgcaggtctagtcagagcctcctgcattcaaatggttacaactatttggattggtacctgcagaagccagggcagtctccacagctcctgatctatgctgcttctaatttacagggtggggtccctgacaggttcagtggcagtggatcaggcacagattttacactgaaaatcagcagagtggaggctgaggatgttggggtttattactgcatgcaaacactagagtcccctgtaactttcggcggagggaccaaggtggagatcaaa

SEQ ID NO: 84 - DNA, 726 bp, Artificial Sequence
  NK77.51_CD70_DB03_F02 scFv
caggtgcagctggtgcagtctggggctgaggtgaagaagcctggggcctcagtgaaggtttcctgcaaggcatctggatacaccttcaccgattactatgtgcactgggtgcgacaggcccctggacaagggcttgagtggatgggaacgatcaaccctagtggtgggagcacaagctacgcacagaagttccagggcagagtcaccatgaccagggacacgtccacgagcacagtctacatggagctgagcagcctgagatctgaggacacggccgtgtattactgtgctagagaccagggactctggttcaccggttttgactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccgggcaagtcagggcattagcaacaatttaaattggtatcagcagaaaccagggaaagcccctaagctcctgatctatgatgcatccaacttggaacgtggggtcccatcaaggttcagtggcagtggatctgggacagatttcactctcaccatcagcagtctgcaacctgaagattttgcaacttactactgtcaacagagttacgacggtcctatcaccttcggccaagggacacgactggagattaaa

SEQ ID NO: 85 - DNA, 726 bp, Artificial Sequence
  NK77.52_CD70_DB03_F05 scFv
caggtgcagctggtgcagtctggggctgaggtgaagaagcctggggcctcagtgaaggtttcctgcaaggcatctggatacaccttcaccgcctaccacatgcactgggtgcgacaggcccctggacaagggcttgagtggatgggaataatcaaccctggagacggtgccacagggtacgcacagaatctccagggcagagtcaccatgaccagggacacgtccacgagcacagtctacatggagctgagcagcctgagatctgaggacacggccgtgtattactgtgctggtgagggcatttccggatcagatgcttttgatatctggggccaagggacattagtcaccgtctcttcaggtggaggcggttcaggcggaggtggctctggcggtggcggatcggacatccagatgacccagtctccatcctccctgtctgcatctgtaggagacagagtcaccatcacttgccgggcaagtcagagcattagcagctggttagcttggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtttgcaggactacagttatcctctcactttcggcggagggaccaaggtggagatcaaa

SEQ ID NO: 86 - DNA, 720 bp, Artificial Sequence
  NK77.53_CD70_DB03_F06 scFv
caggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggatggatgaatcctaactctggtaacacaggttacgcacagaagttccagggcagagtcacgattaccgcggacgaatccacgagcacagcctacatggagctgagcagcctgagatctgaggacacggccgtgtattactgtgcgtggggagtcgatccgtactactttgactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccgggcaagtcagagcattaacaggtggttagcgtggtatcagcagaaaccagggaaagcccctaagctcctgatctatgacgcatccaatttggagaccggggtcccatcaaggttcagtggcagtggatctgggacagatttcactctcaccatcagcagtctgcaacctgaagattttgcaacttactactgtcaacagagttacattacccctctcactttcggcggagggaccaaggtggagatcaaa

SEQ ID NO: 87 - DNA, 720 bp, Artificial Sequence
  NK77.54_CD70_DB03_F09 scFv
caggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaatattcaacccctccgatggtagcacaagctacgcacagaagttccagggcagagtcaccatgaccagggacacgtccacgagcacagtctacatggagctgagcagcctgagatctgaggacacggccgtgtattactgtgctagagatgttggtgagaccacgttcgacccctggggccagggaaccctggtcaccgtctcctcaggtggaggcggttcaggcggaggtggctctggcggtggcggatcggacatccagatgacccagtctccatcctccctgtctgcatctgtaggagacagagtcaccatcacttgccaggcaagtcaggatattagcaactatttaaattggtatcagcagaaaccagggaaagcccctaagctcctgatctatgacgcatccagtttggaaagtggggtcccatcaaggttcagtggcagtggatctgggacagatttcactctcaccatcagcagtctgcaacctgaagattttgcaacttactactgtcaacagactaatagttttcctatcaccttcggccaagggacacgactggagattaaa

SEQ ID NO: 88 - DNA, 735 bp, Artificial Sequence
  NK77.55_CD70_DB03_F12 scFv
caggtgcagctcgttcaaagcggcgccgaggtcaagaaaccaggcgctagcgttaaagttagttgtaaagcctccggctatactttcacatcttacggcatttcttgggtacggcaggcaccggggcagggtttggaatggatggggtggatttccgcctataacggccacacaaattacgcgcagaaattccaggggcgcgttacgatgacacgcgatacctctacctctaccgtttatatggaacttagtagtcttcgttcggaggataccgctgtctactattgcgcacgtgacagtgtacggggttgggactactactacggcatgggggtctggggccaagggaccactgtcaccgtctcctcaggtggaggcggttcaggcggaggtggctctggcggtggcggatcggacatccagatgacccagtctccatcctccctgtctgcatctgtaggagacagagtcaccatcacttgccaggcaagtcaggacattagaaacttcttaaattggtatcagcagaaaccagggaaagcccctaagctcctgatctatgctgcatccacgttgcaaagtggggtcccatcaaggttcagtggcagtggatctgggacagatttcactctcaccatcagcagtctgcaacctgaagattttgcaacttactactgtcaacagagttacagtgcccctagcacttttggccaggggaccaagctggagatcaaa

SEQ ID NO: 89 - DNA, 726 bp, Artificial Sequence
  NK77.56_CD70_DB03_G06 scFv
caggtgcagctggtgcagtctggggctgaggtgaagaagcctgggtcttcagtgaaggtttcctgcaaggcatctggatacaccttcatcgactactatatgcactgggtgcgacaggcccctggacaagggcttgagtggatgggatggatgaaccctcacagtggtaacagtgataatgcaccgaagttccagggcagagtcaccatcaccgcagacgagtccacgagcacagcatacatggagctgagcagcctgagatctgaggacacggccgtgtattactgtgctagaggttactccggatacgatctgacggctgactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccgggcaagtcagagcattagcaattatttaaattggtatcagcagaaaccagggaaagcccctaagctcctgatctatgacgcatccaacttggagaccggggtcccatcaaggttcagtggcagtggatctgggacagatttcactctcaccatcagcagtctgcaacctgaagattttgcaacttactactgtcaacagagttacagtacccctatcaccttcggccaagggacacgactggagattaaa

SEQ ID NO: 90 - DNA, 753 bp, Artificial Sequence
  NK77.57_CD70_DB03_G11 scFv
caggtgcagctggtgcagtctggggctgaggtgaagaagcctggggcctcagtgaaggtctcctgcaaggcttctggatacaccttcaccggccagtatatgcactgggtgcgacaggcccctggacaagggcttgagtggatgggatggatcaacccgaacactggtgacacaaactatgcacagaagtttcagggcagggtcaccatgaccagggacacgtccaccagcacagtatacatggagctgagcagcctgagatctgaagacacggccgtgtattactgtgcgagagacagcgttttcgaggttgaagggggtactgattattattattactacggtatggatgtctggggccaagggacaatggtcaccgtctcttcaggtggaggcggttcaggcggaggtggctctggcggtggcggatcggacatccagatgacccagtctccatcctccctgtctgcatctgtaggagacagagtcaccatcacttgccgggcaagtgaaaccattagcggctggttagcctggtatcagcagaaaccagggaaagcccctaagctcctgatctatgacgcatccaacttggagactggggtcccatcaaggttcagtggcagtggatctgggacagatttcactctcaccatcagcagtctgcaacctgaagattttgcaacttactactgtcaacagagttacagtaccccttggacgttcggccaagggaccaagctggaaatcaaa

SEQ ID NO: 91 - DNA, 723 bp, Artificial Sequence
  NK77.58_CD70_DB03_H08 scFv
caggtgcagctggtgcagtctggggctgaggtgaagaagcctggggcctcagtgaaggtttcctgcaaggcatctggatacaccttcaccagctacgacattaattgggtgcgacaggcccctggacaagggcttgagtggatgggagtgatcaaccctagtggtggaggtacaagctacgcacagaagttccagggcagagtcaccatgaccagggacacgtccacgagcacagtctacatggagctgagcagcctgagatctgaggacacggccgtgtattactgtgctagatattctggctatgattgggtgtttgactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccgggcaagtcagggcattggcagctggttagcttggtatcagcagaaaccagggaaagcccctaagctcctgatctatgctgcatccacattgcaaagtggggtcccatcaaggttcagtggcagtggatctgggacagatttcactctcaccatcagcagtctgcaacctgaagattttgcaacttactactgtcaacagagttacagtaccccttggactttcggccctgggaccaaagtggatatcaaa

SEQ ID NO: 92 - DNA, 726 bp, Artificial Sequence
  NK77.59_CD70_DB03_H10 scFv
caggtgcagctggtgcagtctggggctgaggtgaagaagcctggggcctcagtgaaggtttcctgcaaggcatctggatacaccttcgctaactactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgctagagatagcggctcctactttggttggttcgacccctggggccagggaaccctggtcaccgtctcctcaggtggaggcggttcaggcggaggtggctctggcggtggcggatcggacatccagatgacccagtctccatcctccctgtctgcatctgtaggagacagagtcaccatcacttgccgggcaagtcagagcattagcagctctttagcatggtatcagcagaaaccagggaaagcccctaagctcctgatctatgatgcatccagtttgcaaagtggggtcccatcaaggttcagtggcagtggatctgggacagatttcactctcaccatcagcagtctgcaacctgaagattttgcaacttactactgtcaacagagttacaacacccctcccactttcggcggagggaccaagctggagatcaaa

SEQ ID NO: 93 - DNA, 726 bp, Artificial Sequence
  NK77.60_CD70_DB04_A05 scFv
caggtgcagctggtgcagtctggggctgaggtgaagaagcctggggcctcagtgaaggtttcctgcaaggcatctggatacaccttcaccacatactatatgcactgggtgcgacaggcccctggacaagggcttgagtggatgggaataatcaaccctaccggcggtagcacatactacgcacagaagttccagggcagagtcaccatgaccagggacacgtccacgagcacagtctacatggagctgagcagcctgagatctgaggacacggccgtgtattactgtgctagagacagcgggaactatcaagggatctttgactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccgggcaagtcaggggattggcggctatttagcctggtatcagcagaaaccagggaaagcccctaagctcctgatctatgatgcatccaatttggagaccggggtcccatcaaggttcagtggcagtggatctgggacagatttcactctcaccatcagcagtctgcaacctgaagattttgcaacttactactgtcaacagagttacgactcccctcccaccttcggccaagggacacgactggagattaaa

SEQ ID NO: 94 - DNA, 723 bp, Artificial Sequence
  NK77.61_CD70_DB04_A07 scFv
caggtgcagctggtgcagtctggggctgaggtgaagaagcctggggcctcagtgaaggtttcctgcaaggcatctggaaataccttcaccagctactatatgcactgggtgcgacaggcccctggacaagggcttgagtggatgggatggatcaaccccaacagtggtgacacaaattacgcacagaacttccagggcagagtcaccatgaccagggacacgtccacgagcacagtctacatggagctgagcagcctgagatctgaggacacggccgtgtattactgtgctagaggtgtcagcggttacgatctatttgactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccgggcaagtcagagcgtgagcagctatttaaattggtatcagcagaaaccagggaaagcccctaagctcctgatctatgatacgtccaacttggagacgggggtcccatcaaggttcagtggcagtggatctgggacagatttcactctcaccatcagcagtctgcaacctgaagattttgcaacttactactgtcaacaggctcatagttttcctctcactttcggcggagggaccaaggtggagatcaaa

SEQ ID NO: 95 - DNA, 723 bp, Artificial Sequence
  NK77.62_CD70_DB04_A10 scFv
gaggtgcagctggtggagtctgggggaggcttggtcaagcctggggggtccctgagactctcctgtgcagcgtctggattcaccttcagtagctatggcatgcactgggtccgccaggctccaggcaaggggctggagtgggtggcatcgataaaacatgatggaagtgagcaatactatgttgactccgtgaagggccgattcaccatctccagagacgattccaagaacacgctgtatctgcaaatgaacagcctgaaaacggaggacacggctgtgtattactgtgcggctagtggagtggatgtctggggccaagggacaaccgtcaccgtctcttcaggtggaggcggttcaggcggaggtggctctggcggtggcggatcggatattgtgatgactcagtctccactctccctgcccgtcacccctggagagccggcctccatctcctgcaggtctagtcagagcctcctgcacagcaatggctacaactatttggattggtacctgcagaagccagggcagtctccacagctcctgatctatttgggttctacccgggcctccggggtccctgacaggttcagtggcagtggatcaggcacagattttacactgaaaatcagcagagtggaggctgaggatgttggggtttattactgcatgcaagctctagatactcctctcactttcggcggagggaccaagttagagatcaaa

SEQ ID NO: 96 - DNA, 732 bp, Artificial Sequence
  NK77.63_CD70_DB04_A11 scFv
caggtgcagctggtgcagtctggggctgaggtgaagaagcctggggcctcagtgaaggtttcctgcaaggcatctggaggtaccttcagtcgttacgacattaattgggtgcgacaggcccctggacaagggcttgagtgggtgggaataatcgatcctacaggtgcgtcaacaagctacgcacagaagttccagggcagagtcaccatgaccagggacacgtccacgagcacagtctacatggagctgagcagcctgagatctgaggacacggccgtgtattactgtgctagagattacagttacgggatggattattatggcatggacgtctggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatacctccaatttgcagacaggggtcccatcaaggttcagtggaagtggatctgggacagattttactcttaccatcagcagcctgcagcctgaagattttgcaacatattacctgagcacagatctgcagaccaccgctcacttcggccaagggaccaaggtggaaatcaaa

SEQ ID NO: 97 - DNA, 738 bp, Artificial Sequence
  NK77.64_CD70_DB04_B03 scFv
caggtgcagctggtgcagtctggggctgaggtgaagaagcctgggtcctcggtgaaggtctcctgcaaggcttctggatacaccttcaccagctatggaatcagctgggtgcgacaggcccctggacaagggcttgagtggatgggaggtatcatccctatctttggtacaacgaactacgcacagaagttccagggcagagtcacgattaccgcggacgaatccacgagcacagcctacatggagctgagcagcctgagatctgaggacacggccgtgtattactgtgcgagagatcatagcggcgatgggtacttcgatctctggggccgtggcaccctggtcactgtctcctcaggtggaggcggttcaggcggaggtggctctggcggtggcggatcggatattgtgatgactcagtctccactctccctgcccgtcacccctggagagccggcctccatctcctgcaggtctagtcagagcctcctgcactccaacggatacaactatttggattggtacctgcagaagccagggcagtctccacagctcctgatctatgatgcctcttcacttcagtccggggtccctgacaggttcagtggcagtggatcaggcacagattttacactgaaaatcagcagagtggaggctgaggatgttggggtttattactgcatgcaaggaacacactggcctcccacgttcggccaagggaccaaggtggaaatcaaa

SEQ ID NO: 98 - DNA, 720 bp, Artificial Sequence
  NK77.65_CD70_DB04_B05 scFv
caggtgcagctggtgcagtctggggctgaggtgaagaagcctggggcctcagtgaaggtctcctgcaaggcttctggatacaccttcaccgagaatgagatgcactgggtgcgacaggcccctggacaagggcttgagtggatgggatggatcaacccgaacagtggtggcacaaactatgcacagaagtttcagggcagggtcaccatgaccagggacacgtccactagcacagtgtacatggagctgagctctctgagatctgaagacacggccgtgtattactgtgcggggagctggggtggttactactttgactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccgggcaagtcagagcgttagcagatatttaaattggtatcagcagaaaccagggaaagcccctaagctcctgatctatgatgcatccaatttggaaaccggggtcccatcaaggttcagtggcagtggatctgggacagatttcactctcaccatcagcagtctgcaacctgaagattttgcaacttactactgtcaacaggccgacagtttccctgtgacttttggccaggggaccaagctggagatcaaa

SEQ ID NO: 99 - DNA, 729 bp, Artificial Sequence
  NK77.66_CD70_DB04_B07 scFv
caggtgcagctggtgcagtctggggctgaggtgaagaagcctggggcctcagtgaaggtttcctgcaaggcatctggatacaccttcaccaactactatatctactgggtgcgacaggcccctggacaagggcttgagtggatgggatggatcaaccccaatgacggtgcaacaaattacgcacagaagttccagggcagagtcaccatgaccagggacacgtccacgagcacagtctacatggagctgagcagcctgagatctgaggacacggccgtgtattactgtgctagagaaggcaacgattactattattatttcatggactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccgggcaagtcagggcattagcaacaatttaaattggtatcagcagaaaccagggaaagcccctaagctcctgatctatcatgcatccaacttggagacgggggtcccatcaaggttcagtggcagtggatctgggacagatttcactctcaccatcagcagtctgcaacctgaagattttgcaacttactactgtcaacagagttacgacggccctatgacttttggccaggggaccaagctggagatcaaa

SEQ ID NO: 100 - DNA, 747 bp, Artificial Sequence
  NK77.67_CD70_DB04_C01 scFv
caggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggaggaatcacaccaatgtttggtacaacggactacgcacagaagttccagggcagagtcacgattaccgcggacgaatccacgagcacagcctacatggagctgagcagcctgagatctgaggacacggccgtgtattactgtgcgagagatgagcgggacggatacgccacagtggcttttgatatctggggccaagggacaatggtcaccgtctcttcaggtggaggcggttcaggcggaggtggctctggcggtggcggatcggatattgtgatgactcagtctccactctccctgcccgtcacccctggagagccggcctccatctcctgcaggtctagtcagagcctcctgcatagcaatggatacaactatttggattggtacctgcagaagccagggcagtctccacagctcctgatctatgatgcttctaatcttgagacaggggtccctgacaggttcagtggcagtggatcaggcacagattttacactgaaaatcagcagagtggaggctgaggatgttggggtttattactgcatgcaagggacgcattggcctcccacgttcggccaagggaccaaggtggaaatcaaa

SEQ ID NO: 101 - DNA, 732 bp, Artificial Sequence
  NK77.68_CD70_DB04_C04 scFv
caggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtgacggaggaacaagctacgcagacaagttccagggcagagtcaccatgaccagggacacgtccacgagcacagtctacatggagctgagcagcctgagatctgaggacacggccgtgtattactgtgctagagcgcttgcccccctgggatggggtgacggcatggatgtctggggccaagggacaacagtcaccgtctcttcaggtggaggcggttcaggcggaggtggctctggcggtggcggatcggacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactctcaccatcagcagcctgcagcctgaagatttcgcaacatattactgtcaacagtcatatgatggacctatcaccttcggccaagggacacgactggagattaaa

SEQ ID NO: 102 - DNA, 723 bp, Artificial Sequence
  NK77.69_CD70_DB04_C06 scFv
caggtgcagctggtgcagtctggggctgaggtgaagaagcctgggtcctcggtgaaggtctcctgcaaggcttctggatacaccttcactagctattacatccactgggtgcgacaggcccctggacaagggcttgagtggatgggatggatgaatccctcctcaggtgttacgaacttcgcacagaagttccagggcagagtcacgattaccgcggacgaatccacgagcacagcctacatggagctgagcagcctgagatctgaggacacggccgtgtattactgtgcgagaggttcggaccagggtgactggtctgacccctggggccagggaaccctggtcaccgtctcctcaggtggaggcggttcaggcggaggtggctctggcggtggcggatcggacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgacgcatccaacttggaaacgggggtcccatcaaggttcagtggcagtggatctgggacagatttcactctcaccatcagcagtctgcaacctgaagattttgcaacttactactgtcaacagagttacaatacccctccaactttcggcggagggaccaaggtggagatcaaa

SEQ ID NO: 103 - DNA, 732 bp, Artificial Sequence
  NK77.70_CD70_DB04_C07 scFv
caggtgcagctggtgcagtctggggctgaggtgaagaagcctggggcctcagtgaaggtttcctgcaaggcatctggatacaccttcaccgactcctatatacactgggtgcgacaggcccctggacaagggcttgagtggattggatggatgaaccctaatacaggtgacacaggctacgcacagaagttccagggcagagtcaccatgaccagggacacgtccacgagcacagtctacatggagctgagcagcctgagatctgaggacacggccgtgtattactgtgctaaggacgactttggagagcttgctccagccaccttcgacccctggggccagggaaccctggtcaccgtctcctcaggtggaggcggttcaggcggaggtggctctggcggtggcggatcggacatccagatgacccagtctccatcctccctgtctgcatctgtaggagacagagtcaccatcacttgccaggcaagtcaggacattagcaattatttaaattggtatcagcagaaaccagggaaagcccctaagctcctgatctatggtgcatccagtttgcaaagtggggtcccatcaaggttcagtggcagtggatctgggacagatttcactctcaccatcagcagtctgcaacctgaagattttgcaacttactactgtctgcaggatgcggcgacccctatcaccttcggccaagggacacgactggagattaaa

SEQ ID NO: 104 - DNA, 732 bp, Artificial Sequence
  NK77.71_CD70_DB04_D02 scFv
caggtgcagctggtgcagtctggggctgaggtgaagaagcctggggcctcagtgaaggtttcctgcaaggcatctggatacaccttcaccagctacgacatcaattgggtgcgacaggcccctggacaagggcttgagtggatgggagtcatcagccctagtggtggtggaacaagctacgcacagaagttccagggcagagtcaccatgaccagggacacgtccacgagcacagtctacatggagctgagcagcctgagatctgaggacacggccgtgtattactgtgctagatactacggcggcaaccccgaagggtggtacttcgatctctggggccgtggcaccctggtcactgtctcctcaggtggaggcggttcaggcggaggtggctctggcggtggcggatcggacatccagatgacccagtctccatcctccctgtctgcatctgtaggagacagagtcaccatcacttgccgggcaagtcagagcattggaaattggttagcctggtatcagcagaaaccagggaaagcccctaagctcctgatctatgacgcatccgatttggaaaccggggtcccatcaaggttcagtggcagtggatctgggacagatttcactctcaccatcagcagtctgcaacctgaagattttgcaacttactactgtcaacagagttacactaccccttggacgttcggccaagggaccaaggtggaaatcaaa

SEQ ID NO: 105 - DNA, 777 bp, Artificial Sequence
  NK77.72_CD70_DB04_D05 scFv
gaggtgcagctgctggagtctgggggaggcctcgtccagcctgggggctccctgagactctcctgtgcagcctctggattcgttttcgatgactatgctatccactgggtccgccaggctccgggcaaggggctagagtgggtggcagcgatatcatatgatggaagtaataaatactacgcagactccgtgaagggccgattcaccatctccagagacaattccaagaacacgctgtatctgcaaatgaacagcctgagagctgaggacacggctgtgtattactgtgcgagagctccacaatattatgggagtggcaccgacccacttgaggttagatactactactacggcatggacgtgtggggccaagggaccacggtcaccgtctcctcaggtggaggcggttcaggcggaggtggctctggcggtggcggatcggatattgtgatgactcagtctccactctccctgcccgtcacccctggagagccggcctccatctcctgcaggtctagtcagagcctcttgcattctaatggctacaactatttggattggtacctgcagaagccagggcagtctccacagctcctgatctatgaagtctctaatcgggcctccggggtccctgacaggttcagtggcagtggatcaggcacagattttacactgaaaatcagcagagtggaggctgaggatgttggggtttattactgcatgaaaggcctacaaactcctctgactttcggccctgggaccaaagtggatatcaaa

SEQ ID NO: 106 - DNA, 732 bp, Artificial Sequence
  NK77.73_CD70_DB04_D07 scFv
caggtgcagctggtgcagtctggggctgaggtgaagaagcctgggtcctcggtgaaggtctcctgcaaggcttctggaggcaccttccgcaattatgctatcagctgggtgcgacaggcccctggacaagggcttgagtggatgggaggtatcatccctatctttggtacagcaaactacgcacagaagttccagggcagagtcacgattaccgcggacgaatccacgagcacagcctacatggagctgagcagcctgagatctgaggacacggccgtgtattactgtgcgagagatcacagtgctgggactcaccacgacgcttttgatatctggggccaagggacaatggtcaccgtctcttcaggtggaggcggttcaggcggaggtggctctggcggtggcggatcggacatccagatgacccagtctccatcctccctgtctgcatctgtaggagacagagtcaccatcacttgccgggcaagtcagggcattagcaactatttagcctggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagtcacagtacccctctcactttcggccaagggaccaaggtggagatcaaa

SEQ ID NO: 107 - DNA, 717 bp, Artificial Sequence
  NK77.74_CD70_DB04_D08 scFv
caggtgcagctggtgcagtctggggctgaggtgaagaagcctggggcctcagtgaaggtctcctgcaaggcttctggatacaccttcaccagttattatatccactgggtgcgacaggccccgggacaagggcttgagtggatgggatggatgaacccaaacagtggtaacgccggctatgcacagaagttccagggcagagtcaccatgaccagggatacctccacaagcacagtgtacatggagctgagcagcctgagatctgaggacacggccgtgtattactgtgcgagagagtactgggggagctttgactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccgggcaagtcaggggattagcaataacttaaattggtatcagcagaaaccagggaaagcccctaagctcctgatctatgatgcatccaacttggaaactggggtcccatcaaggttcagtggcagtggatctgggacagatttcactctcaccatcagcagtctgcaacctgaagattttgcaacttactactgtcaacagagttacagtaccccttatacgttcggccaagggaccaaggtggaaatcaaa

SEQ ID NO: 108 - DNA, 720 bp, Artificial Sequence
  NK77.75_CD70_DB04_D10 scFv
caggtgcagctggtgcagtctggggctgaggtgaagaagcctggggcctcagtgaaggtttcctgcaaggcatctggatacaccttcaccggctactatatgcactgggtgcgacaggcccctggacaagggcttgagtggatgggaatgatcgatccaagcgacggtagcacaatttacgcacagaagttccagggcagagtcaccatgaccagggacacgtccacgagcacagtctacatggagctgagcagcctgagatctgaggacacggccgtgtattactgtgctagagagcggccactgtacgcttccgacctgtggggccaagggaccctggtcaccgtctcctcaggtggaggcggttcaggcggaggtggctctggcggtggcggatcggatatccagatgacccagtctccatcctccctgtctgcatctgtaggagacagagtcaccatcacttgccgggcaagtcaggacattggaaatgatttaggctggtatcagcagaaaccagggaaagcccctaagctcctgatctatgctgcatccagtttacaaagtggggtcccatcaaggttcagcggcagtggatctggcacagatttcactctcaccatcagcagcctgcagcctgaagattttgcaacttattactgtctacaagattacgactaccctctcactttcggccaggggaccaaggtggagatcaaa

SEQ ID NO: 109 - DNA, 723 bp, Artificial Sequence
  NK77.85_CD70_DB03_B02 scFv
caggtgcagctggtgcagtctggggctgaggtgaagaagcctgggtcttcagtgaaggtttcctgcaaggcatctggatacaccttcaccaactactatatgcactgggtgcgacaggcccctggacaagggcttgagtggatgggatggatgaaccccgatagtggtaatacagggtacgcacagaagttccagggcagagtcaccatcaccgctgacgaatccacgagcacagcctacatggagctgagcagcctgagatctgaggacacggccgtgtattactgtgctagaagtagcagctcctggcctgacttcgatctctggggccgtggcaccctggtcactgtctcctcaggtggaggcggttcaggcggaggtggctctggcggtggcggatcggacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgatgcatccaacttggagactggggtcccatcaaggttcagtggcagtggatctgggacagatttcactctcaccatcagcagtctgcaacctgaagattttgcaacttactactgtcaacagagttacaacaccccttacagttttggccaggggaccaaggtggagatcaaa

SEQ ID NO: 110 - DNA, 726 bp, Artificial Sequence
  NK77.86_CD70_DB04_A06 scFv
caggtccaactcgtacaatccggcgcagaagtcaaaaaacccggcgcaagcgtcaaggtatcatgtaaagctagcgggtatacatttacatcctattccatgcattgggtacgccaagctccaggccagggcctggaatgggtcggtatcattaatcccagttccggctctgccagttatgcgcaaaaatttcaaggaagggtgacaatgactcgagataccagtacctccactgtgtatatggaactgtcctcactaaggagcgaagatactgctgtatactactgcgcacgcgaacgtggggcctatagtagtaccttcgactattggggtcagggcacgttagtgacagtgtcttccggtggaggcggttcaggcggaggtggctctggcggtggcggatcggacatccagatgacccagtctccatcctccctgtctgcatctgtaggagacagagtcaccatcacttgccggacaagtcagagcattagcagctatttaaattggtatcagcagaaaccagggaaagcccctaagctcctgatctatgacgcatccaatttggaaaccggggtcccatcaaggttcagtggcagtggatctgggacagatttcactctcaccatcagcagtctgcaacctgaagattttgcaacttactactgtcttcaggactacagttaccctctcactttcggccaagggaccaaggtggagatcaaa

SEQ ID NO: 111 - DNA, 726 bp, Artificial Sequence
  NK77.87_CD70_DB04_A09 scFv
caggtgcagctggtgcagtctggggctgaggtgaagaagcctggggcctcagtgaaggtttcctgcaaggcatctggatacaccttcaccgactactatatgcactgggtgcgacaggcccctggacaagggcttgagtggatgggagtcatcaacccctctgatggtacagctcattacgcacagcggctgcagggcagagtcaccatgaccagggacacgtccacgagcacagtctacatggagctgagcagcctgagatctgaggacacggccgtgtattactgtgctagagacagcggatcttactacgctgactttgactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccaggcaagtcaggacattagcaattatttaaattggtatcagcagaaaccagggaaagcccctaagctcctgatctatgatgcatccagtttgcaaagtggggtcccatcaaggttcagtggcagtggatctgggacagatttcactctcaccatcagcagtctgcaacctgaagattttgcaacttactactgtcaacagagttacagtacccctcccgccttcggccaagggaccaaggtggaaatcaaa

SEQ ID NO: 112 - DNA, 1521 bp, Artificial Sequence
  NK77.76_38-38 scFv
caggtgcagctggtgcagtctggggctgaggtgaagaagcctggggcctcagtgaaggtttcctgcaaggcatctggatacagtttcaccagctactatatgcactgggtgcgacaggcccctggacaagggcttgagtggatgggaataatcaaccctagtggtgggactacaagctacgcacagaagttccagggcagagtcaccatgaccagggacacgtccacgagcacagtctacatggagctgagcagcctgagatctgaggacacggccgtgtattactgtgctagagacaattccccgtatagctcaagctggtgggactactttgactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccgggcaagtcaggacattcggcattatttagcatggtatcagcagaaaccagggaaagcccctaagctcctgatctatgacgcatccagtttgcaaagtggggtcccatcaaggttcagtggcagtggatctgggacagatttcactctcaccatcagcagtctgcaacctgaagattttgcaacttactactgtcaacagacctacgacgcacctatcaccttcggccaagggacacgactggagattaaaggtggcggtggctcgggcggtggtgggtcgggtggcggcggatctcaggtgcagctggtgcagtctggggctgaggtgaagaagcctggggcctcagtgaaggtttcctgcaaggcatctggatacagtttcaccagctactatatgcactgggtgcgacaggcccctggacaagggcttgagtggatgggaataatcaaccctagtggtgggactacaagctacgcacagaagttccagggcagagtcaccatgaccagggacacgtccacgagcacagtctacatggagctgagcagcctgagatctgaggacacggccgtgtattactgtgctagagacaattccccgtatagctcaagctggtgggactactttgactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccgggcaagtcaggacattcggcattatttagcatggtatcagcagaaaccagggaaagcccctaagctcctgatctatgacgcatccagtttgcaaagtggggtcccatcaaggttcagtggcagtggatctgggacagatttcactctcaccatcagcagtctgcaacctgaagattttgcaacttactactgtcaacagacctacgacgcacctatcaccttcggccaagggacacgactggagattaaa

SEQ ID NO: 113 - DNA, 1521 bp, Artificial Sequence
  NK77.77_64-64 scFv
caggtgcagctggtgcagtctggggctgaggtgaagaagcctgggtcctcggtgaaggtctcctgcaaggcttctggatacaccttcaccagctatggaatcagctgggtgcgacaggcccctggacaagggcttgagtggatgggaggtatcatccctatctttggtacaacgaactacgcacagaagttccagggcagagtcacgattaccgcggacgaatccacgagcacagcctacatggagctgagcagcctgagatctgaggacacggccgtgtattactgtgcgagagatcatagcggcgatgggtacttcgatctctggggccgtggcaccctggtcactgtctcctcaggtggaggcggttcaggcggaggtggctctggcggtggcggatcggatattgtgatgactcagtctccactctccctgcccgtcacccctggagagccggcctccatctcctgcaggtctagtcagagcctcctgcactccaacggatacaactatttggattggtacctgcagaagccagggcagtctccacagctcctgatctatgatgcctcttcacttcagtccggggtccctgacaggttcagtggcagtggatcaggcacagattttacactgaaaatcagcagagtggaggctgaggatgttggggtttattactgcatgcaaggaacacactggcctcccacgttcggccaagggaccaaggtggaaatcaaaggtggcggtggctcgggcggtggtgggtcgggtggcggcggatctcaggtgcagctggtgcagtctggggctgaggtgaagaagcctgggtcctcggtgaaggtctcctgcaaggcttctggatacaccttcaccagctatggaatcagctgggtgcgacaggcccctggacaagggcttgagtggatgggaggtatcatccctatctttggtacaacgaactacgcacagaagttccagggcagagtcacgattaccgcggacgaatccacgagcacagcctacatggagctgagcagcctgagatctgaggacacggccgtgtattactgtgcgagagatcatagcggcgatgggtacttcgatctctggggccgtggcaccctggtcactgtctcctcaggtggaggcggttcaggcggaggtggctctggcggtggcggatcggatattgtgatgactcagtctccactctccctgcccgtcacccctggagagccggcctccatctcctgcaggtctagtcagagcctcctgcactccaacggatacaactatttggattggtacctgcagaagccagggcagtctccacagctcctgatctatgatgcctcttcacttcagtccggggtccctgacaggttcagtggcagtggatcaggcacagattttacactgaaaatcagcagagtggaggctgaggatgttggggtttattactgcatgcaaggaacacactggcctcccacgttcggccaagggaccaaggtggaaatcaaa

SEQ ID NO: 114 - DNA, 1485 bp, Artificial Sequence
  NK77.78_65-65 scFv
caggtgcagctggtgcagtctggggctgaggtgaagaagcctggggcctcagtgaaggtctcctgcaaggcttctggatacaccttcaccgagaatgagatgcactgggtgcgacaggcccctggacaagggcttgagtggatgggatggatcaacccgaacagtggtggcacaaactatgcacagaagtttcagggcagggtcaccatgaccagggacacgtccactagcacagtgtacatggagctgagctctctgagatctgaagacacggccgtgtattactgtgcggggagctggggtggttactactttgactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccgggcaagtcagagcgttagcagatatttaaattggtatcagcagaaaccagggaaagcccctaagctcctgatctatgatgcatccaatttggaaaccggggtcccatcaaggttcagtggcagtggatctgggacagatttcactctcaccatcagcagtctgcaacctgaagattttgcaacttactactgtcaacaggccgacagtttccctgtgacttttggccaggggaccaagctggagatcaaaggtggcggtggctcgggcggtggtgggtcgggtggcggcggatctcaggtgcagctggtgcagtctggggctgaggtgaagaagcctggggcctcagtgaaggtctcctgcaaggcttctggatacaccttcaccgagaatgagatgcactgggtgcgacaggcccctggacaagggcttgagtggatgggatggatcaacccgaacagtggtggcacaaactatgcacagaagtttcagggcagggtcaccatgaccagggacacgtccactagcacagtgtacatggagctgagctctctgagatctgaagacacggccgtgtattactgtgcggggagctggggtggttactactttgactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccgggcaagtcagagcgttagcagatatttaaattggtatcagcagaaaccagggaaagcccctaagctcctgatctatgatgcatccaatttggaaaccggggtcccatcaaggttcagtggcagtggatctgggacagatttcactctcaccatcagcagtctgcaacctgaagattttgcaacttactactgtcaacaggccgacagtttccctgtgacttttggccaggggaccaagctggagatcaaa

SEQ ID NO: 115 - DNA, 1530 bp, Artificial Sequence
  NK77.79_38-67 scFv
caggtgcagctggtgcagtctggggctgaggtgaagaagcctggggcctcagtgaaggtttcctgcaaggcatctggatacagtttcaccagctactatatgcactgggtgcgacaggcccctggacaagggcttgagtggatgggaataatcaaccctagtggtgggactacaagctacgcacagaagttccagggcagagtcaccatgaccagggacacgtccacgagcacagtctacatggagctgagcagcctgagatctgaggacacggccgtgtattactgtgctagagacaattccccgtatagctcaagctggtgggactactttgactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccgggcaagtcaggacattcggcattatttagcatggtatcagcagaaaccagggaaagcccctaagctcctgatctatgacgcatccagtttgcaaagtggggtcccatcaaggttcagtggcagtggatctgggacagatttcactctcaccatcagcagtctgcaacctgaagattttgcaacttactactgtcaacagacctacgacgcacctatcaccttcggccaagggacacgactggagattaaaggtggcggtggctcgggcggtggtgggtcgggtggcggcggatctcaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggaggaatcacaccaatgtttggtacaacggactacgcacagaagttccagggcagagtcacgattaccgcggacgaatccacgagcacagcctacatggagctgagcagcctgagatctgaggacacggccgtgtattactgtgcgagagatgagcgggacggatacgccacagtggcttttgatatctggggccaagggacaatggtcaccgtctcttcaggtggaggcggttcaggcggaggtggctctggcggtggcggatcggatattgtgatgactcagtctccactctccctgcccgtcacccctggagagccggcctccatctcctgcaggtctagtcagagcctcctgcatagcaatggatacaactatttggattggtacctgcagaagccagggcagtctccacagctcctgatctatgatgcttctaatcttgagacaggggtccctgacaggttcagtggcagtggatcaggcacagattttacactgaaaatcagcagagtggaggctgaggatgttggggtttattactgcatgcaagggacgcattggcctcccacgttcggccaagggaccaaggtggaaatcaaa

SEQ ID NO: 116 - DNA, 1515 bp, Artificial Sequence
  NK77.80_38-68 scFv
caggtgcagctggtgcagtctggggctgaggtgaagaagcctggggcctcagtgaaggtttcctgcaaggcatctggatacagtttcaccagctactatatgcactgggtgcgacaggcccctggacaagggcttgagtggatgggaataatcaaccctagtggtgggactacaagctacgcacagaagttccagggcagagtcaccatgaccagggacacgtccacgagcacagtctacatggagctgagcagcctgagatctgaggacacggccgtgtattactgtgctagagacaattccccgtatagctcaagctggtgggactactttgactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccgggcaagtcaggacattcggcattatttagcatggtatcagcagaaaccagggaaagcccctaagctcctgatctatgacgcatccagtttgcaaagtggggtcccatcaaggttcagtggcagtggatctgggacagatttcactctcaccatcagcagtctgcaacctgaagattttgcaacttactactgtcaacagacctacgacgcacctatcaccttcggccaagggacacgactggagattaaaggtggcggtggctcgggcggtggtgggtcgggtggcggcggatctcaggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtgacggaggaacaagctacgcagacaagttccagggcagagtcaccatgaccagggacacgtccacgagcacagtctacatggagctgagcagcctgagatctgaggacacggccgtgtattactgtgctagagcgcttgcccccctgggatggggtgacggcatggatgtctggggccaagggacaacagtcaccgtctcttcaggtggaggcggttcaggcggaggtggctctggcggtggcggatcggacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactctcaccatcagcagcctgcagcctgaagatttcgcaacatattactgtcaacagtcatatgatggacctatcaccttcggccaagggacacgactggagattaaa

SEQ ID NO: 117 - DNA, 1530 bp, Artificial Sequence
  NK77.81_64-67 scFv
caggtgcagctggtgcagtctggggctgaggtgaagaagcctgggtcctcggtgaaggtctcctgcaaggcttctggatacaccttcaccagctatggaatcagctgggtgcgacaggcccctggacaagggcttgagtggatgggaggtatcatccctatctttggtacaacgaactacgcacagaagttccagggcagagtcacgattaccgcggacgaatccacgagcacagcctacatggagctgagcagcctgagatctgaggacacggccgtgtattactgtgcgagagatcatagcggcgatgggtacttcgatctctggggccgtggcaccctggtcactgtctcctcaggtggaggcggttcaggcggaggtggctctggcggtggcggatcggatattgtgatgactcagtctccactctccctgcccgtcacccctggagagccggcctccatctcctgcaggtctagtcagagcctcctgcactccaacggatacaactatttggattggtacctgcagaagccagggcagtctccacagctcctgatctatgatgcctcttcacttcagtccggggtccctgacaggttcagtggcagtggatcaggcacagattttacactgaaaatcagcagagtggaggctgaggatgttggggtttattactgcatgcaaggaacacactggcctcccacgttcggccaagggaccaaggtggaaatcaaaggtggcggtggctcgggcggtggtgggtcgggtggcggcggatctcaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggaggaatcacaccaatgtttggtacaacggactacgcacagaagttccagggcagagtcacgattaccgcggacgaatccacgagcacagcctacatggagctgagcagcctgagatctgaggacacggccgtgtattactgtgcgagagatgagcgggacggatacgccacagtggcttttgatatctggggccaagggacaatggtcaccgtctcttcaggtggaggcggttcaggcggaggtggctctggcggtggcggatcggatattgtgatgactcagtctccactctccctgcccgtcacccctggagagccggcctccatctcctgcaggtctagtcagagcctcctgcatagcaatggatacaactatttggattggtacctgcagaagccagggcagtctccacagctcctgatctatgatgcttctaatcttgagacaggggtccctgacaggttcagtggcagtggatcaggcacagattttacactgaaaatcagcagagtggaggctgaggatgttggggtttattactgcatgcaagggacgcattggcctcccacgttcggccaagggaccaaggtggaaatcaaa

SEQ ID NO: 118 - DNA, 1515 bp, Artificial Sequence
  NK77.82_64-68 scFv
caggtgcagctggtgcagtctggggctgaggtgaagaagcctgggtcctcggtgaaggtctcctgcaaggcttctggatacaccttcaccagctatggaatcagctgggtgcgacaggcccctggacaagggcttgagtggatgggaggtatcatccctatctttggtacaacgaactacgcacagaagttccagggcagagtcacgattaccgcggacgaatccacgagcacagcctacatggagctgagcagcctgagatctgaggacacggccgtgtattactgtgcgagagatcatagcggcgatgggtacttcgatctctggggccgtggcaccctggtcactgtctcctcaggtggaggcggttcaggcggaggtggctctggcggtggcggatcggatattgtgatgactcagtctccactctccctgcccgtcacccctggagagccggcctccatctcctgcaggtctagtcagagcctcctgcactccaacggatacaactatttggattggtacctgcagaagccagggcagtctccacagctcctgatctatgatgcctcttcacttcagtccggggtccctgacaggttcagtggcagtggatcaggcacagattttacactgaaaatcagcagagtggaggctgaggatgttggggtttattactgcatgcaaggaacacactggcctcccacgttcggccaagggaccaaggtggaaatcaaaggtggcggtggctcgggcggtggtgggtcgggtggcggcggatctcaggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtgacggaggaacaagctacgcagacaagttccagggcagagtcaccatgaccagggacacgtccacgagcacagtctacatggagctgagcagcctgagatctgaggacacggccgtgtattactgtgctagagcgcttgcccccctgggatggggtgacggcatggatgtctggggccaagggacaacagtcaccgtctcttcaggtggaggcggttcaggcggaggtggctctggcggtggcggatcggacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactctcaccatcagcagcctgcagcctgaagatttcgcaacatattactgtcaacagtcatatgatggacctatcaccttcggccaagggacacgactggagattaaa

SEQ ID NO: 119 - DNA, 1512 bp, Artificial Sequence
  NK77.83_65-67 scFv
caggtgcagctggtgcagtctggggctgaggtgaagaagcctggggcctcagtgaaggtctcctgcaaggcttctggatacaccttcaccgagaatgagatgcactgggtgcgacaggcccctggacaagggcttgagtggatgggatggatcaacccgaacagtggtggcacaaactatgcacagaagtttcagggcagggtcaccatgaccagggacacgtccactagcacagtgtacatggagctgagctctctgagatctgaagacacggccgtgtattactgtgcggggagctggggtggttactactttgactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccgggcaagtcagagcgttagcagatatttaaattggtatcagcagaaaccagggaaagcccctaagctcctgatctatgatgcatccaatttggaaaccggggtcccatcaaggttcagtggcagtggatctgggacagatttcactctcaccatcagcagtctgcaacctgaagattttgcaacttactactgtcaacaggccgacagtttccctgtgacttttggccaggggaccaagctggagatcaaaggtggcggtggctcgggcggtggtgggtcgggtggcggcggatctcaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggaggaatcacaccaatgtttggtacaacggactacgcacagaagttccagggcagagtcacgattaccgcggacgaatccacgagcacagcctacatggagctgagcagcctgagatctgaggacacggccgtgtattactgtgcgagagatgagcgggacggatacgccacagtggcttttgatatctggggccaagggacaatggtcaccgtctcttcaggtggaggcggttcaggcggaggtggctctggcggtggcggatcggatattgtgatgactcagtctccactctccctgcccgtcacccctggagagccggcctccatctcctgcaggtctagtcagagcctcctgcatagcaatggatacaactatttggattggtacctgcagaagccagggcagtctccacagctcctgatctatgatgcttctaatcttgagacaggggtccctgacaggttcagtggcagtggatcaggcacagattttacactgaaaatcagcagagtggaggctgaggatgttggggtttattactgcatgcaagggacgcattggcctcccacgttcggccaagggaccaaggtggaaatcaaa

SEQ ID NO: 120 - DNA, 1497 bp, Artificial Sequence
  NK77.84_65-68 scFv
caggtgcagctggtgcagtctggggctgaggtgaagaagcctggggcctcagtgaaggtctcctgcaaggcttctggatacaccttcaccgagaatgagatgcactgggtgcgacaggcccctggacaagggcttgagtggatgggatggatcaacccgaacagtggtggcacaaactatgcacagaagtttcagggcagggtcaccatgaccagggacacgtccactagcacagtgtacatggagctgagctctctgagatctgaagacacggccgtgtattactgtgcggggagctggggtggttactactttgactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccgggcaagtcagagcgttagcagatatttaaattggtatcagcagaaaccagggaaagcccctaagctcctgatctatgatgcatccaatttggaaaccggggtcccatcaaggttcagtggcagtggatctgggacagatttcactctcaccatcagcagtctgcaacctgaagattttgcaacttactactgtcaacaggccgacagtttccctgtgacttttggccaggggaccaagctggagatcaaaggtggcggtggctcgggcggtggtgggtcgggtggcggcggatctcaggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtgacggaggaacaagctacgcagacaagttccagggcagagtcaccatgaccagggacacgtccacgagcacagtctacatggagctgagcagcctgagatctgaggacacggccgtgtattactgtgctagagcgcttgcccccctgggatggggtgacggcatggatgtctggggccaagggacaacagtcaccgtctcttcaggtggaggcggttcaggcggaggtggctctggcggtggcggatcggacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactctcaccatcagcagcctgcagcctgaagatttcgcaacatattactgtcaacagtcatatgatggacctatcaccttcggccaagggacacgactggagattaaa

SEQ ID NO: 121 - DNA, 23 bp, Artificial Sequence
  CD70 guide RNA 1
tcaccaagcccgcgaccaatggg

SEQ ID NO: 122 - DNA, 23 bp, Artificial Sequence
  CD70 guide RNA 2
gctttggtcccattggtcgcggg

SEQ ID NO: 123 - DNA, 23 bp, Artificial Sequence
  CD70 guide RNA 3
accctcctccggcatcgccgcgg

SEQ ID NO: 124 - DNA, 20 bp, Artificial Sequence
  TGFBR2 gRNA 1
cccctaccatgactttattc

SEQ ID NO: 125 - DNA, 20 bp, Artificial Sequence
  TGFBR2 gRNA 2
attgcactcatcagagctac

SEQ ID NO: 126 - DNA, 20 bp, Artificial Sequence
  TGFBR2 gRNA 3
agtcatggtaggggagcttg

SEQ ID NO: 127 - DNA, 20 bp, Artificial Sequence
  TGFBR2 gRNA 4
tgctggcgatacgcgtccac

SEQ ID NO: 128 - DNA, 20 bp, Artificial Sequence
  TGFBR2 gRNA 5
gtgagcaatcccccgggcga

SEQ ID NO: 129 - DNA, 20 bp, Artificial Sequence
  TGFBR2 gRNA 6
aacgtgcggtgggatcgtgc

SEQ ID NO: 130 - DNA, 20 bp, Artificial Sequence
  CISH gRNA 1
ctcaccagattcccgaaggt

SEQ ID NO: 131 - DNA, 20 bp, Artificial Sequence
  CISH gRNA 2
ccgccttgtcatcaaccgtc

SEQ ID NO: 132 - DNA, 20 bp, Artificial Sequence
  CISH gRNA 3
tctgcgttcaggggtaagcg

SEQ ID NO: 133 - DNA, 20 bp, Artificial Sequence
  CISH gRNA 4
gcgcttacccctgaacgcag

SEQ ID NO: 134 - DNA, 20 bp, Artificial Sequence
  CISH gRNA 5
cgcagaggaccatgtccccg

SEQ ID NO: 135 - DNA, 20 bp, Artificial Sequence
  NKG2A gRNA 1
ggagctgatggtaaatctgc

SEQ ID NO: 136 - DNA, 20 bp, Artificial Sequence
  NKG2A gRNA 2
ttgaaggtttaattccgcat

SEQ ID NO: 137 - DNA, 20 bp, Artificial Sequence
  NKG2A gRNA 3
aacaactatcgttaccacag

SEQ ID NO: 138 - DNA, 2169 bp, Artificial Sequence
  NK77.1_CD70_DB01_C03 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctggggcctcagtgaaggtctcctgcaaggcttctggatacaccttcaccggccattatttgcactgggtgcgacaggcccctggacaagggcttgagtggatgggatggatcaaccctaacagtggtggcacaaactatgcacagaagtttcagggcagggtcaccatgaccagggacacgtccactagcacagtgtacatggagctgagcagcctgagatctgaggacacggccgtgtattactgtgttagaggaagcggttggtatgacctggactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccgggcaagtcagaatattggcacatatttagcttggtatcagcagaaaccagggaaagcccctaagctcctgatctatgacgcatccaacttggagactggggtcccatcaaggttcagtggcagtggatctgggacagatttcactctcaccatcagcagtctgcaacctgaagattttgcaacttactactgtcaacagagttacagaatccctctcaccttcggccaagggacacgactggagattaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 139 - DNA, 2172 bp, Artificial Sequence
  NK77.2_CD70_DB01_D02 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctggggcctcagtgaaggtttcctgcaaggcatctggatacaccttcaccaactactatatgcactgggtgcgacaggcccctggacaagggcttgagtggatgggaataatcaaccctagtggtgggagcacaagctacgcacagaagttccagggcagagtcaccatgaccagggacacgtccacgagcacagtctacatggagctgagcagcctgagatctgaggacacggccgtgtattactgtgctagagaactaggagtcgccgggtacttcgatctctggggccgtggcaccctggtcactgtctcctcaggtggaggcggttcaggcggaggtggctctggcggtggcggatcggacatccagatgacccagtctccatcctccctgtctgcatctgtaggagacagagtcaccatcacttgccgggcgagtcagaggattagcaattggttagcctggtatcagcagaaaccagggaaagcccctaagctcctgatctatgatgcatccaacttggaaaccggggtcccatccaggttcagtggcagtggatctgggacggattttactctcaccatcagcagcctgcagcctgaagattttgcaacttattactgtcaacagacctatagtcctccccctacttttggccaggggaccaagctggagatcaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 140 - DNA, 2199 bp, Artificial Sequence
  NK77.3_CD70_DB01_E06 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctggggcctcagtgaaggtttcctgcaaggcatctggatacaccttcaccggttactatatccactgggtgcgacaggcccctggacaagggcttgagtggatgggaataatcaaccctagtggtggaagcacaagctacgcacagaagttccagggcagagtcaccatgaccagggacacgtccacgagcacagtctacatggagctgagcagcctgagatctgaggacacggccgtgtattactgtgctagagacctgtcagggatcgacggatatattggtttctttgactactggggccaagggaccctggtcaccgtctcctcaggtggaggcggttcaggcggaggtggctctggcggtggcggatcggatattgtgatgactcagtctccactctccctgcccgtcacccctggagagccggcctccatctcctgcaggtctagtcagagcctcctgcactctaacggatacaactatttggattggtacctgcagaagccagggcagtctccacagctcctgatctatgcagcctcttcattacaatccggggtccctgacaggttcagtggcagtggatcaggcacagattttacactgaaaatcagcagagtggaggctgaggatgttggggtttattactgcatgcaagctctacaaactcctatcaccttcggccaagggacacgactggagattaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 141 - DNA, 2172 bp, Artificial Sequence
  NK77.4_CD70_DB01_G04 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctggggcctcagtgaaggtttcctgcaaggcatctggaggaaccttcagaagccatgtcatatcctgggtgcgacaggcccctggacaagggcttgagtggatgggaataatcgatcctagtggtggcagcacaagctacgcacagaggttccagggcagagtcaccatgaccagggacacgtccacgagcacagtctacatggagctgagcagcctgagatctgaggacacggccgtgtattactgtgctaaagattacactgggctgcttggaatggatgtctggggccaagggacaaccgtcaccgtctcttcaggtggaggcggttcaggcggaggtggctctggcggtggcggatcggacatccagatgacccagtctccatcctccctgtctgcatctgtaggagacagagtcaccatcacttgccgggcaagtcaggacattgacacctatttagcctggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacacaacccctttcacgttcggccaagggaccaaggtggaaatcaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 142 - DNA, 2172 bp, Artificial Sequence
  NK77.5_CD70_DB01_G05 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctggggcctcagtgaaggtctcctgcaaggcttctggatacaccttcatcgactattatatccattgggtgcgacaggcccctggacaagggcttgagtggatgggatggatgaaccccaacagtggtaacacaggctatgcacagaagttccagggcagagtcaccatgaccagggacacctccacaagcacagtctacatggagctgagcagcctgagatctgaggacacggccgtgtattactgtgcgagaggcctttccggctacgacttggacgactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccaggcaagtcaggacattagcaactatttaaattggtatcagcagaaaccagggaaagcccctaagctcctgatctatgatgcatccagtttggaaagtggggtcccatcaaggttcagtggcagtggatctgggacagatttcactctcaccatcagcagtctgcaacctgaagattttgcaacttactactgtcaacagagttaccgatcacctctcactttcggcggagggaccaaggtggagatcaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 143 - DNA, 2169 bp, Artificial Sequence
  NK77.6_CD70_DB01_G07 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggatggatcaacccgaacagtggtggcacaaaatacgcacataagttccagggcagagtcaccatgaccagggacacgtccacgagcacagtctacatggagctgagcagcctgagatctgaggacacggccgtgtattactgtgctagaggactgtcaggttacgattttgactactggggccaagggaccacagtcaccgtctcctcaggtggaggcggttcaggcggaggtggctctggcggtggcggatcggacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttgaccatcagcagcctgcagcctgaagattttgcaacatattactgtcaacaggcttataggtggcctatcaccttcggccaagggacacgactggagattaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 144 - DNA, 2172 bp, Artificial Sequence
  NK77.7_CD70_DB01_G11 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctggggcctcagtgaaggtttcctgcaaggcatctggatacaccttcaccggctactatatgcactgggtgcgacaggcccctggacaagggcttgagtggatgggatggatgaaccctaatagtggtaacacaggctacgcacagaagttccagggcagagtcaccatgaccagggacacgtccacgagcacagtctacatggagctgagcagcctgagatctgaggacacggccgtgtattactgtgctagagggaccgacgtgtatggagactttgactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgatgcatcctacttggaaacaggggtcccatcaaggttcagtggcagtggatctgggacagatttcactctcaccatcagcagtctgcaacctgaagattttgcaacttactactgtcaacagagttacacaattcctcctacgttcggccaagggaccaaggtggaaatcaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 145 - DNA, 2193 bp, Artificial Sequence
  NK77.9_CD70_DB02_A03 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctgggtcctcggtgaaggtctcctgcaaggcttctggatacaccttcacagagaacgaaatgcattgggtgcgacaggcccctggacaagggcttgagtggatgggaggcatcatccctatctttggtacagcaaactacgcacagaagttccagggcagagtcacgattaccgcggacgaatccacgagcacagcctacatggagctgagcagcctgagatctgaggacacggccgtgtattactgtgcgagagagggaggaaccgccatggccaccggttattactactatgggatggacgtgtggggccaagggaccaccgtcaccgtctcctcaggtggaggcggttcaggcggaggtggctctggcggtggcggatcggacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactctcaccatcagcagcctgcagcctgaagattttgcaacatattactgtcaacagagctattccacccctctcactttcggccaggggaccaaggtggagatcaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 146 - DNA, 2187 bp, Artificial Sequence
  NK77.10_CD70_DB02_A04 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctggggcctcagtgaaggtttcctgcaaggcatctggatacaccttcaccgagaatgaaatgcactgggtgcgacaggcccctggacaagggcttgagtggatgggatggatcaactctaatggtggctacacagggtacgcactgaagttccagggcagagtcaccatgaccagggacacgtccacgagcacagtctacatggagctgagcagcctgagatctgaggacacggccgtgtattactgtgctagagccagtaattacggaggacactttgactactggggccaagggaccctggtcaccgtctcctcaggtggaggcggttcaggcggaggtggctctggcggtggcggatcggatattgtgatgactcagtctccactctccctgcccgtcacccctggagagccggcctccatctcctgcaggtctagtcagagcctcctgcattccaacggatacaactatttggattggtacctgcagaagccagggcagtctccacagctcctgatctatcaggcatctagcctggagtccggggtccctgacaggttcagtggcagtggatcaggcacagattttacactgaaaatcagcagagtggaggctgaggatgttggggtttattactgcatgcaaggaacgcactggcctccaactttcggcggagggaccaaggtggagatcaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 147 - DNA, 2172 bp, Artificial Sequence
  NK77.11_CD70_DB02_A05 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggcagcacaatatacgcacagaagttccagggcagagtcaccatgaccagggacacgtccacgagcacagtctacatggagctgagcagcctgagatctgaggacacggccgtgtattactgtgctaaagacatgggagcgtgggcagctggttttgactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccaagcaagtcaggacattagcaactatttaaattggtatcagcagaaaccagggaaagcccctaagctcctgatctatgctacctccaccttggctaacggggtcccatcaaggttcagtggcagtggatctgggacagatttcactctcaccatcagcagtctgcaacctgaagattttgcaacttactactgtcaacagagttacagtacgcttaccttcggccaagggacacgactggagattaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 148 - DNA, 2175 bp, Artificial Sequence
  NK77.12_CD70_DB02_A06 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctggggcctcagtgaaggtttcctgcaaggcatctggatacaccttcaccgggtactatatgcactgggtgcgacaggcccctggacaagggcttgagtggatgggatggatcaacccaaatagtggtgatacagggtacgcacagaagttccagggcagagtcaccatgaccagggacacgtccacgagcacagtctacatggagctgagcagcctgagatctgaggacacggccgtgtattactgtgctagatccgtcaacgactacggtgattacgacggttactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactctgaccatcagcagcctgcagcctgaagattttgcaacatattactgtcaacagtcttacagtacgcctcctacgttcggccaagggaccaaggtggaaatcaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 149 - DNA, 2175 bp, Artificial Sequence
  NK77.13_CD70_DB02_A07 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctggggcctcagtgaaggtttcctgcaaggcatctggatacaccttcaccggatactatatgcactgggtgcgacaggcccctggacaagggcttgagtggatgggaataatcaaccctagtggtgggagcacaagctacgcacagaagttccagggcagagtcaccatgaccagggacacgtccacgagcacagtctacatggagctgagcagcctgagatctgaggacacggccgtgtattactgtgctagagattacggtgattatgacgcctcgtttgactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccgggcaagtcagagcattgacaattggttagcgtggtatcagcagaaaccagggaaagcccctaagctcctgatctatgctgcatccacattgcaaagtggggtcccatcaaggttcagtggcagtggatctgggacagatttcactctcaccatcagcagtctgcaacctgaagattttgcaacttactactgtcaacagagttacgatagtcctcccacttttggccaggggaccaagctggagatcaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 150 - DNA, 2166 bp, Artificial Sequence
  NK77.14_CD70_DB02_A08 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctggggcctcagtgaaggtttcctgcaaggcatctggatacaccttcaccagctacgatatcaattgggtgcgacaggcccctggacaagggcttgagtggatgggaataatcaacccctccgatggtagcacaatctacgcacagaacttccagggcagagtcaccatgaccagggacacgtccacgagcacagtctacatggagctgagcagcctgagatctgaggacacggccgtgtattactgtgtgaaggaagaggcctggtacttcgatctctggggccgtggcaccctggtcactgtctcctcaggtggaggcggttcaggcggaggtggctctggcggtggcggatcggacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttgaccatcagcagcctgcagcctgaagattttgcaacatattactgtcaacagtcctatagcacccctctcactttcggcggagggaccaaggtggagatcaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 151 - DNA, 2166 bp, Artificial Sequence
  NK77.15_CD70_DB02_A09 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggatggatgaaccctgataacggtgatacagggtacgcacagatgttccagggcagagtcaccatgaccagggacacgtccacgagcacagtctacatggagctgagcagcctgagatctgaggacacggccgtgtattactgtgcttcaggggattactatgacatcttgtactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgtgtccaatttggaaacaggggtcccatcaaggttcagtggaagtggatctgggacagattttactctcaccatcagcagcctgcagcctgaagattttgcaacatattactgtcaacaggctaattccttccctctcactttcggcggagggaccaaggtggagatcaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 152 - DNA, 2169 bp, Artificial Sequence
  NK77.16_CD70_DB02_A11 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggatggatgaaccccaacagtggtgatacaggatacgcacagaagttccagggcagagtcaccatgaccagggacacgtccacgagcacagtctacatggagctgagcagcctgagatctgaggacacggccgtgtattactgtgctagagggcccagcgggtacgaatttgactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccgggcaagtcagaccattagcaattatttaaattggtatcagcagaaaccagggaaagcccctaagctcctgatctatgacgcatccagtttggaaagtggggtcccatcaaggttcagtggcagtggatctgggacagatttcactctcaccatcagcagtctgcaacctgaagattttgcaacttactactgtcaacaggcaatcagttttcctctcactttcggcggagggaccaaggtggagatcaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 153 - DNA, 2181 bp, Artificial Sequence
  NK77.17_CD70_DB02_B06 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctggggcctcagtgaaggtttcctgcaaggcatctggatacaccttcaccgattactatatgcactgggtgcgacaggcccctggacaagggcttgagtggatgggaataatcaaccctaatagtggtggaacaaattacgcacagaagttccagggcagagtcaccatgaccagggacacgtccacgagcacagtctacatggagctgagcagcctgagatctgaggacacggccgtgtattactgtgctagagattttagtgtgtatgctgctgcagatggcatggatgtctggggccaagggacattggtcaccgtctcttcaggtggaggcggttcaggcggaggtggctctggcggtggcggatcggacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgacgcatccaatttggccaccggggtcccatcaaggttcagtggcagtggatctgggacagatttcactctcaccatcagcagtctgcaacctgaagattttgcaacttactactgtcaacagagtgatagttcacctctcactttcggccaagggaccaaggtggagatcaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 154 - DNA, 2178 bp, Artificial Sequence
  NK77.18_CD70_DB02_B09 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctggggcctcagtgaaggtttcctgcaaggcatctggatacaccttcaccgggtactatatgcactgggtgcgacaggcccctggacaagggcttgagtggatgggaataatcaaccctggggatggcggtacaatctacgcacagaatttccagggcagagtcaccatgaccagggacacgtccacgagcacagtctacatggagctgagcagcctgagatctgaggacacggccgtgtattactgtgctagaggattcggcgagtcagcccccgatgcttttgatatctggggccaagggacaatggtcaccgtctcttcaggtggaggcggttcaggcggaggtggctctggcggtggcggatcggacatccagatgacccagtctccatcctccctgtctgcatctgtaggagacagagtcaccatcacttgccaggcaagtcaggacattagcaattatttaaattggtatcagcagaaaccagggaaagcccctaagctcctgatctatggtgcaacgacattgcaaagtggggtcccatcaaggttcagtggcagtggatctgggacagatttcactctcaccatcagcagtctgcaacctgaagattttgcaacttactactgtcaacaggcggatagttttccttacacttttggccaggggaccaagctggagatcaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 155 - DNA, 2169 bp, Artificial Sequence
  NK77.19_CD70_DB02_C03 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctggggcctcagtgaaggtttcctgcaaggcatctggatacaccttcaccggttactatatgcactgggtgcgacaggcccctggacaagggcttgagtggatgggaataatcaaccctagtggtgggagcacaagctacgcacagaagttccagggcagagtcaccatgaccagggacacgtccacgagcacagtctacatggagctgagcagcctgagatctgaggacacggccgtgtattactgtgctgccgggacagagatctactacatggacgtctggggcaaagggaccacggtcaccgtctcctcaggtggaggcggttcaggcggaggtggctctggcggtggcggatcggacatccagatgacccagtctccatcctccctgtctgcatctgtaggagacagagtcaccatcacttgcagggcgagtcagactattgacatctatttaaattggtatcagcagaaaccagggaaagcccctaagctcctgatctacgatgcatccaatttggaaacaggggtcccatcaaggttcagtggaagtggatctgggacagattttactttgaccatcagcagcctgcagcctgaagattttgcaacatattactgtcaacaggcagattccttccctctcactttcggcggagggaccaaggtggagatcaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 156 - DNA, 2196 bp, Artificial Sequence
  NK77.20_CD70_DB02_C04 construct
atggccttaccagtgaccgccttgctcctgccgctggccttgctgctccacgccgccaggccggactacaaagacgatgacgataaaggcggtggtggctctggtggtggcggatcccaagtgcagttagttcagtcaggcgccgaagttaaaaaacccggagcgagcgtaaaagtgtcttgtaaagccagtggcggcacatttagctcttatgcgatatcatgggttcgccaagcaccaggccagggcctggaatggatggggatgataaatccaagtgatggcgccactacttacgcacagaagttccagggcagagtcaccatgaccagggacacgtccacgagcacagtctacatggagctgagcagcctgagatctgaggacacggccgtgtattactgtgctagagagagggagctactacatttcgccacaaattattactactatggtatggacgtgtggggccaagggaccaccgtcaccgtctcctcaggtggaggcggttcaggcggaggtggctctggcggtggcggatcggacatccagatgacccagtctccatcttctctgtctgcatctgtaggagacagagtcaccatcacttgtcgggcgagtcagggtattagcaacaacttaaattggtatcagcagaaaccagggaaagcccctaagctcctgatctatgctgcatccagtttgcacagtggggtcccatcaaggttcagcggcagtggatctgggacagatttcactctcactatcagcagcctgcagcctgaagattttgcaacttactattgtcaacaggctgatgctttccctctcactttcggcggagggaccaaggtggagatcaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 157 - DNA, 2184 bp, Artificial Sequence
  NK77.22_CD70_DB02_C07 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctggggcctcagtgaaggtttcctgcaaggcatctggatacaccttcacccggaactatatgcactgggtgcgacaggcccctggacaagggcttgagtggatgggatggatctctcctgacaatggtgttacaaattacgcacagaatttccagggcagagtcaccatgaccagggacacgtccacgagcacagtctacatggagctgagcagcctgagatctgaggacacggccgtgtattactgtgctaagacacaaggctcatccagctggtatcagtggtacttcgatctctggggccgtggcaccctggtcactgtctcctcaggtggaggcggttcaggcggaggtggctctggcggtggcggatcggacatccagatgacccagtctccatcctccctgtctgcatctgtaggagacagagtcaccatcacttgccgggcaagtcagagcattggaacctggttagcctggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacaccacccctattacgttcggccaagggaccaaggtggaaatcaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 158 - DNA, 2172 bp, Artificial Sequence
  NK77.24_CD70_DB02_D02 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcgatccagggagtggtgacacaagctacgcacagaagttccagggcagagtcaccatgaccagggacacgtccacgagcacagtctacatggagctgagcagcctgagatctgaggacacggccgtgtattactgtgctagagggtccaactggtacgactactttgactactggggccaagggaccctggtcaccgtctcctcaggtggaggcggttcaggcggaggtggctctggcggtggcggatcggaaatagtgatgacgcagtctccagccaccctgtctgtgtctccaggggaaagagccaccctctcctgcagggccagtcagagtgttagcagctacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtatgatagctatcctccaactttcggcggagggaccaaggtggagatcaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 159 - DNA, 2172 bp, Artificial Sequence
  NK77.25_CD70_DB02_D04 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctggggcctcagtgaaggtttcctgcaaggcatctggataccgcctgagcgaccattatatgcactgggtgcgacaggcccctggacaagggcttgagtggatgggaataatcaaccctagtggtgggagcacaacatacgcacagaacttccagggcagagtcaccatgaccagggacacgtccacgagcacagtctacatggagctgagcagcctgagatctgaggacacggccgtgtattactgtgcttccagttactatggtgactacgtcttggtgaattggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccaggcaagtcaggacattagcaattatttaaattggtatcagcagaaaccagggaaagcccctaagctcctgatctatgctgcatccaccttggaaagtggggtcccatcaaggttcagtggcagtggatctgggacagatttcactctcaccatcagcagtctgcaacctgaagattttgcaacttactactgtcttcaggattacgactaccctctgacttttggccaggggaccaagctggagatcaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 160 - DNA, 2175 bp, Artificial Sequence
  NK77.26_CD70_DB02_D10 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctggggcctcagtgaaggtttcctgcaaggcatctggatacaccttcaccgattactatgtccactgggtgcgacaggcccctggacaagggcttgagtggatgggatggatcaacccgaatactggtgggacaagcttcgcacagaatttccagggcagagtcaccatgaccagggacacgtccacgagcacagtctacatggagctgagcagcctgagatctgaggacacggccgtgtattactgtgctagagatctgggtcaatggttgggagagattgactactggggccaagggaccctggtcaccgtctcctcaggtggaggcggttcaggcggaggtggctctggcggtggcggatcggacatccagatgacccagtctccatcttctctctctgcatctgtaggagacagagtcaccatcacttgtcgggcgagtcagacaatttataagtggttagcctggtatcagcagaaaccagggaaagcccctaagctcctgatctatgacgcatccagtttggaaagtggggtcccatcaaggttcagcggcagtggatctgggacagatttcactctcactatcagcagcctgcagcctgaagattttgcaacttactattgtcaacaggctaacagtttccctttcactttcggccctgggaccaaagtggatatcaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 161 - DNA, 2187 bp, Artificial Sequence
  NK77.27_CD70_DB02_D11 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctggggcctcagtgaaggtttcctgcaaggcatctggatacaccttcaccgactacaccgattactttgtgcactgggtgcgacaggcccctggacaagggcttgagtggatgggaatattcaaccctagtgatggtagcacaagctacgcacaggaattccagggcagagtcaccatgaccagggacacgtccacgagcacagtctacatggagctgagcagcctgagatctgaggacacggccgtgtattactgtgctagaggaccttacagtagtagctggtattactttgactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactctgaccatcagcagcctgcagcctgaagatttcgcaacatattactgtcaacaggcccactcgtttcctcccacgttcggccaagggaccaaggtggaaatcaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 162 - DNA, 2175 bp, Artificial Sequence
  NK77.28_CD70_DB02_E04 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctggggcctcagtgaaggtttcctgcaaggcatctggatacatcttcaccgattactatatgcactgggtgcgacaggcccctggacaagggcttgagtggatgggaataatcaaccctagtggtggagatacactttacgcacagaagttccagggcagagtcaccatgaccagggacacgtccacgagcacagtctacatggagctgagcagcctgagatctgaggacacggccgtgtattactgtgctagagaaggcgtaggagctatgggcgtgtttgactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccgggcaagtaccagcattagcgattatgtgcattggtatcagcagaaaccagggaaagcccctaagctcctgatctatgatgcatccagtttgcaaagtggggtcccatcaaggttcagtggcagtggatctgggacagatttcactctcaccatcagcagtctgcaacctgaagattttgcaacttactactgtcaacagagtgatagtacccctcccactttcggcggagggaccaaggtggagatcaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 163 - DNA, 2181 bp, Artificial Sequence
  NK77.29_CD70_DB02_F06 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctggggcctcagtgaaggtttcctgcaaggcatctggatacaccttcaccgatcactatatccactgggtgcgacaggcccctggacaagggcttgagtggatgggatggatcagtgcgtacaatggtaaaacaaattacgcacagaagttccagggcagagtcaccatgaccagggacacgtccacgagcacagtctacatggagctgagcagcctgagatctgaggacacggccgtgtattactgtgctagagacacaatctactatgacttttggagtgggtacgactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccgggcaagtcagggaattagcaataatttaaattggtatcagcagaaaccagggaaagcccctaagctcctgatctattacgcatccaccttgcaaagtggggtcccatcaaggttcagtggcagtggatctgggacagatttcactctcaccatcagcagtctgcaacctgaagattttgcaacttactactgtcaacagagttacagtacccctatcaccttcggccaagggacacgactggagattaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 164 - DNA, 2181 bp, Artificial Sequence
  NK77.31_CD70_DB02_F08 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggcgcgacaatctacgcacagaagttccagggcagagtcaccatgaccagggacacgtccacgagcacagtctacatggagctgagcagcctgagatctgaggacacggccgtgtattactgtgctagatctcgcggtgactactatggaagcggggattttgactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccgggcaagtcagacgattagcaattatttaaattggtatcagcagaaaccagggaaagcccctaagctcctgatctatgatgcatccacgttggaagccggggtcccatcaaggttcagtggcagtggatctgggacagatttcactctcaccatcagcagtctgcaacctgaagattttgcaacttactactgtcaacagagttacaaccctccatacacttttggccaggggaccaagctggagatcaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 165 - DNA, 2169 bp, Artificial Sequence
  NK77.32_CD70_DB02_G07 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctggggcctcagtgaaggtttcctgcaaggcatctggatacaccttcaccgattactatatgcactgggtgcgacaggcccctggacaagggcttgagtggatgggaataatcaaccctagtggtggaagcacaagctacgcacagaagttccagggcagagtcaccatgaccagggacacgtccacgagcacagtctacatggagctgagcagcctgagatctgaggacacggccgtgtattactgtgctagaggatattttgatcacgcattcgatatctggggccaagggacaatggtcaccgtctcttcaggtggaggcggttcaggcggaggtggctctggcggtggcggatcggacatccagatgacccagtctccatcctccctgtctgcatctgtaggagacagagtcaccatcacttgccgggcaagtcagagcattagcacttatttaaattggtatcagcagaaaccagggaaagcccctaagctcctgatctatgatgcatccaacttggagatcggggtcccatcaaggttcagtggcagtggatctgggacagatttcactctcaccatcagcagtctgcaacctgaagattttgcaacttactactgtcaacagagtgacagttcaccactcactttcggccaggggaccaaggtggagatcaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 166 - DNA, 2187 bp, Artificial Sequence
  NK77.33_CD70_DB02_H04 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctggggcctcagtgaaggtttcctgcaaggcatctggatacaccttcaccggttactatatgcactgggtgcgacaggcccctggacaagggcttgagtggatgggaataatcaaccctagtggtggggatacaatatacgcacagaagttccagggcagagtcaccatgaccagggacacgtccacgagcacagtctacatggagctgagcagcctgagatctgaggacacggccgtgtattactgtgctagaggtgactcgtcttcatggtacgactattactactacatggacgtctggggcaaagggaccacggtcaccgtctcctcaggtggaggcggttcaggcggaggtggctctggcggtggcggatcggacatccagatgacccagtctccatcctccctgtctgcatctgtaggagacagagtcaccatcacttgccaagcaagtcaggatattagcaactatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttaccggacccctctcactttcggcggagggaccaaggtggagatcaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 167 - DNA, 2172 bp, Artificial Sequence
  NK77.34_CD70_DB02_H05 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctggggcctcagtgaaggtttcctgcaaggcatctggatacaccttcaccgactactttacccactgggtgcgacaggcccctggacaagggcttgagtggatgggatggatcaacacatatgacggtaatacaaattacgcacagaagttccagggcagagtcaccatgaccagggacacgtccacgagcacagtctacatggagctgagcagcctgagatctgaggacacggccgtgtattactgtgctagagaaatggagtggctcggccaggtggactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccgggcaagtcaggatattcgcaacgatttagggtggtatcagcagaaaccagggaaagcccctaagctcctgatctatgctgcatccaacttggagaccggggtcccatcaaggttcagtggcagtggatctgggacagatttcactctcaccatcagcagtctgcaacctgaagattttgcaacttactactgtcaacagagttacagtgcacctttcactttcggccctgggaccaaagtggatatcaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 168 - DNA, 2172 bp, Artificial Sequence
  NK77.35_CD70_DB02_H08 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctggggcctcagtgaaggtttcctgcaaggcatctggatacaccttcaccagctactatatacactgggtgcgacaggcccctggacaagggcttgagtggatgggacgaatcaaccctaatggtggagggacaaactacgcacagaagttccagggcagagtcaccatgaccagggacacgtccacgagcacagtctacatggagctgagcagcctgagatctgaggacacggccgtgtattactgtgctagaggccacagagggggtggcgggattgactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccgggcaagtcaggagattagcaactatttagcctggtatcagcagaaaccagggaaagcccctaagctcctgatctatgatgcatccaacttgcaaactggggtcccatcaaggttcagtggcagtggatctgggacagatttcactctcaccatcagcagtctgcaacctgaagattttgcaacttactactgtcaacagagttacagtacccctttcactttcggccctgggaccaaagtggatatcaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 169 - DNA, 2172 bp, Artificial Sequence
  NK77.36_CD70_DB03_A06 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctggggcctcagtgaaggtttcctgcaaggcatctggaggtaccttcagtagctacgcaatttcatgggtgcgacaggcccctggacaagggcttgagtggatgggatggatctctcccaacagtggtgacacacactacgcacagaagttccagggcagagtcaccatgaccagggacacgtccacgagcacagtctacatggagctgagcagcctgagatctgaggacacggccgtgtattactgtgctagagactgggggtcaggctggtacgtggactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccaggcaagtcaggacattagcgattctttaaattggtatcagcagaaaccagggaaagcccctaagctcctgatctattccgcatccagtttgcaaagtggggtcccatcaaggttcagtggcagtggatctgggacagatttcactctcaccatcagcagtctgcaacctgaagattttgcaacttactactgtcaacagagttttacaaccccttatacgttcggccaagggaccaaggtggaaatcaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 170 - DNA, 2172 bp, Artificial Sequence
  NK77.37_CD70_DB03_A07 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctgggtcctcggtgaaggtctcctgcaaggcttctggaggcaccttcaatagctatggaatcagctgggtgcgacaggcccctggacaagggcttgagtggatgggaggtatcatccctatctttggtacagcaaactacgcacagaagttccagggcagagtcacgattaccgcggacgaatccacgagcacagcctacatggagctgagcagcctgagatctgaggacacggccgtgtattactgtgcgagagatacctacggggatgacgcttttgatatctggggccaagggacaatggtcaccgtctcttcaggtggaggcggttcaggcggaggtggctctggcggtggcggatcggacatccagatgacccagtctccatcttctctgtctgcatctgtaggagacagagtcaccatcacttgtcgggcgagtcagtctattagcagctggttagcctggtatcagcagaaaccagggaaagcccctaagctcctgatctatgatgcatccaatttggaaacaggggtcccatcaaggttcagcggcagtggatctgggacagatttcactctcactatcagcagcctgcagcctgaagattttgcaacttactattgtcaacagaatttcagtcctcctctcaccttcggccaagggacacgactggagattaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 171 - DNA, 2187 bp, Artificial Sequence
  NK77.38_CD70_DB03_A08 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctggggcctcagtgaaggtttcctgcaaggcatctggatacagtttcaccagctactatatgcactgggtgcgacaggcccctggacaagggcttgagtggatgggaataatcaaccctagtggtgggactacaagctacgcacagaagttccagggcagagtcaccatgaccagggacacgtccacgagcacagtctacatggagctgagcagcctgagatctgaggacacggccgtgtattactgtgctagagacaattccccgtatagctcaagctggtgggactactttgactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccgggcaagtcaggacattcggcattatttagcatggtatcagcagaaaccagggaaagcccctaagctcctgatctatgacgcatccagtttgcaaagtggggtcccatcaaggttcagtggcagtggatctgggacagatttcactctcaccatcagcagtctgcaacctgaagattttgcaacttactactgtcaacagacctacgacgcacctatcaccttcggccaagggacacgactggagattaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 172 - DNA, 2181 bp, Artificial Sequence
  NK77.39_CD70_DB03_A09 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctggggcctcagtgaaggtttcctgcaaggcatctggatacaccttcaccgattactatattcactgggtgcgacaggcccctggacaagggcttgagtggatgggatggatcaccccgaacagtggttatacatattacgcacagaatttccagggcagagtcaccatgaccagggacacgtccacgagcacagtctacatggagctgagcagcctgagatctgaggacacggccgtgtattactgtgctagaaacacagactgttatggggacttcctggggctggatgtctggggccaagggacaacggtcaccgtctcttcaggtggaggcggttcaggcggaggtggctctggcggtggcggatcggacatcgtgatgacccagtctccagactccctggctgtgtctctgggcgagagggccaccatcaactgccgggccagctctagtatttccaactacttagcttggtaccagcagaaaccaggacagcctcctaagctgctcatttacggcgcatctacccgggcttccggggtccctgaccgattcagtggcagcgggtctgggacagatttcactctcaccatcagcagcctgcaggctgaagatgtggcagtttattactgtcagcaaagctatagtactcctctcactttcggccaggggaccaaggtggagatcaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 173 - DNA, 2181 bp, Artificial Sequence
  NK77.40_CD70_DB03_A11 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctggggcctcagtgaaggtttcctgcaaggcatctggatacaccttcaacggctaccttatgcactgggtgcgacaggcccctggacaagggcttgagtggatgggaatagttaacccttccgatggtagcacaggctacgcacagaagttccagggcagagtcaccatgaccagggacacgtccacgagcacagtctacatggagctgagcagcctgagatctgaggacacggccgtgtattactgtgcgaaggacacaggactccgctactttgactggctacttgactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccgggcgagtcagggcattaccaattttttagcctggtatcagcagaaaccagggaaagcccctaagctcctgatatatgatgcatccaacttggaaaccggggtcccatccaggttcagtggcagtggatctgggacggatttcactctcaccatcagcagcctgcagcctgaagattttgcaacttattactgtcaacagagctatggggcccctcttaccttcggccaagggacacgactggagattaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 174 - DNA, 2169 bp, Artificial Sequence
  NK77.41_CD70_DB03_A12 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcgatcctagtggtggccgaacaatttacgcacagcgcttccagggcagagtcaccatgaccagggacacgtccacgagcacagtctacatggagctgagcagcctgagatctgaggacacggccgtgtattactgtgctagacacgaagcaggcggaatctttgactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccaagcaagtcaggacattagcaactatttaaattggtatcagcagaaaccagggaaagcccctaagctcctgatctattccgcatccaccttgcaaagtggggtcccatcaaggttcagtggcagtggatctgggacagatttcactctcaccatcagcagtctgcaacctgaagattttgcaacttactactgtcaacagagttacagttctccttatagattcggccaagggaccaaggtggaaatcaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 175 - DNA, 2193 bp, Artificial Sequence
  NK77.42_CD70_DB03_B01 construct
atggccttaccagtgaccgccttgctcctgccgctggccttgctgctccacgccgccaggccggactacaaagacgatgacgataaaggcggtggtggctctggtggtggcggatcccaggtccagctggtgcagtctggggctgaggtgaagaagcctgggtcctcagtgaaggtctcctgcaaggcttctggatataccttcagcgactcctacatgcattgggtgcgacaggcccctggacaagggcttgagtgggtcggagggatcatccctatggcaggtatacccgcctacgcagaggaattccagggcagagtcacgattaccgcggacgagtccacgagcacagcctacatggagctgagcagcctgagatctgaggacacggccgtgtattactgtgcgagagccgacgattatgggggaaattggtacttcgatctctggggccgtggcaccctggtcactgtctcctcaggtggaggcggttcaggcggaggtggctctggcggtggcggatcggatattgtgatgactcagtctccactctccctgcccgtcacccctggagagccggcctccatctcctgcaggtctagtcagagcctcctccactctaatggctacaactatttggattggtacctgcagaagccagggcagtctccacagctcctgatctatgcagcttctagtctccagtccggggtccctgacaggttcagtggcagtggatcaggcacagattttacactgaaaatcagcagagtggaggctgaggatgttggggtttattactgcatgcaaggggcccattggcctccgacttttggccaggggaccaagctggagatcaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 176 - DNA, 2175 bp, Artificial Sequence
  NK77.43_CD70_DB03_B04 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctggggcctcagtgaaggtttcctgcaaggcatctggatacatcttcaccgactactatatgcactgggtgcgacaggcccctggacaagggcttgagtggatgggaataatcaaccctagtggtggcagcacaagctacgcacagaagttccagggcagagtcaccatgaccagggacacgtccacgagcacagtctacatggagctgagcagcctgagatctgaggacacggccgtgtattactgtgctagagactcaggatggtatgagtcctggttcgacccctggggccagggaaccctggtcaccgtctcctcaggtggaggcggttcaggcggaggtggctctggcggtggcggatcggacatccagatgacccagtctccatcctccctgtctgcatctgtaggagacagagtcaccatcacttgccgggcaagtcaggacattagggatgggttaggctggtatcagcagaaaccagggaaagcccctaagctcctgatctatgctgcatccactttgcaaagtggggtcccatcaaggttcagtggcagtggatctgggacagatttcactctcaccatcagcagtctgcaacctgaagattttgcaacttactactgtcaacagagttacgggacccctcctacgttcggccaagggaccaaggtggaaatcaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 177 - DNA, 2178 bp, Artificial Sequence
  NK77.44_CD70_DB03_B06 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctggggcctcagtgaaggtttcctgcaaggcatctggatacaccttcaccgactactatcttcactgggtgcgacaggcccctggacaagggcttgagtggatgggatggatcagcgcctacaatggtaacacaaattacgcacagaagttccagggcagagtcaccatgaccagggacacgtccacgagcacagtctacatggagctgagcagcctgagatctgaggacacggccgtgtattactgtgctagagagattgtgggtgctacagaagattggtacttcgatctctggggccgtggcaccctggtcactgtctcctcaggtggaggcggttcaggcggaggtggctctggcggtggcggatcggaaatagtgatgacgcagtctccagccaccctgtctgtgtctccaggggaaagagccaccctctcctgcagggccagtcagagtgttagcagctatttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtatgattcctcccctacgttcggccaagggaccaaggtggaaatcaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 178 - DNA, 2172 bp, Artificial Sequence
  NK77.45_CD70_DB03_B09 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctggggcctcagtgaaggtttcctgcaaggcatctggatacaccttcaccgcctactatctgcactgggtgcgacaggcccctggacaagggcttgagtggatgggaatgatcaaccccaacaatggtggcacaatttacgcacagacattccagggcagagtcaccatgaccagggacacgtccacgagcacagtctacatggagctgagcagcctgagatctgaggacacggccgtgtattactgtgctagagacctgggcggctacgtcctgtttgactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgatgcatccaacttggaaaccggggtcccatcaaggttcagtggcagtggatctgggacagatttcactctcaccatcagcagtctgcaacctgaagattttgcaacttactactgtcaacagagtcacagtgcgcctatcaccttcggccaagggacacgactggagattaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 179 - DNA, 2172 bp, Artificial Sequence
  NK77.46_CD70_DB03_C05 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctggggcctcagtgaaggtttcctgcaaggcatctggatacaccttcaccgactactatattcactgggtgcgacaggcccctggacaagggcttgagtggatgggaatgatcaaccctagaggaggtagcacaacttacgcacagtcattccagggcagagtcaccatgaccagggacacgtccacgagcacagtctacatggagctgagcagcctgagatctgaggacacggccgtgtattactgtgctagagatttaggtgactatggggactacgactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccgggcaagtcagagcattagcacaaacttagcttggtatcagcagaaaccagggaaagcccctaagctcctgatctatgatgcatcctatttggaggctggggtcccatcaaggttcagtggcagtggatctgggacagatttcactctcaccatcagcagtctgcaacctgaagattttgcaacttactactgtcaacagagttacagtacccctccgacttttggccaggggaccaagctggagatcaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 180 - DNA, 2205 bp, Artificial Sequence
  NK77.47_CD70_DB03_D11 construct
atggccttaccagtgaccgccttgctcctgccgctggccttgctgctccacgccgccaggccggactacaaagacgatgacgataaaggcggtggtggctctggtggtggcggatccgaggtgcagctgttggagtctgggggaggcttggtacagcctggggggtccctgagactctcctgtgcagcctctggattcacctttagcaattcagatatgaattgggtccgccaggctccagggaaggggctggagtgggtctcagctattagtggtggaggtgacacactctactacgcagactccgtgaagggccggttcaccatctccagagacaattccaagaacacgctgtatctgcaaatgaacagcctgagagccgaggacacggccgtatattactgtgcgatggccagcgctttggacagtagcggtgacaatgaggcttttgatatctggggccaagggacaacagtcaccgtctcttcaggtggaggcggttcaggcggaggtggctctggcggtggcggatcggacatcgtgatgacccagtctccagactccctggctgtgtctctgggcgagagggccaccatcaactgcaagtccagccagagtgttttatattccagtaataacaagaactacttagcttggtaccagcagaaaccaggacagcctcctaagctgctcatttactgggcatctacccgggattccggggtccctgaccgattcagtggcagcgggtctgggacagatttcactctcaccatcagcagcctgcaggctgaagatgtggcagtttattactgtcagcaatattatggcttccctcccaccttcggccaagggacacgactggagattaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 181 - DNA, 2181 bp, Artificial Sequence
  NK77.48_CD70_DB03_E01 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggatggatcaacccaaataacggtggtacaagctacgcacagaagttccagggcagagtcaccatgaccagggacacgtccacgagcacagtctacatggagctgagcagcctgagatctgaggacacggccgtgtattactgtgctagagtggaggacgatttctggagcggccctagctttgactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccaagcaagtcacgacattagcaaattcttaaattggtatcagcagaaaccagggaaagcccctaagctcctgatctatgatgcatccaatttgcaacgaggggtcccatcaaggttcagtggcagtggatctgggacagatttcactctcaccatcagcagtctgcaacctgaagattttgcaacttactactgtcaacagacctacagtttccctttcacttttggccaggggaccaagctggagatcaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 182 - DNA, 2187 bp, Artificial Sequence
  NK77.49_CD70_DB03_E03 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctgggtcctcggtgaaggtctcctgcaaggcttctggaggcaccttcaccaattatgctttcagctgggtgcgacaggcccctggacaagggcttgagtggatgggaggtatcatccctatcagcggtgccgcaaactacgcacagaagttccagggcagagtcacgattaccgcggacgaatccacgagcacagcctacatggagctgagcagcctgagatctgaggacacggccgtgtattactgtgcgagagggtccggactggacgatgcttttgatatctggggccaagggacaatggtcaccgtctcttcaggtggaggcggttcaggcggaggtggctctggcggtggcggatcggatattgtgatgactcagtctccactctccctgcccgtcacccctggagagccggcctccatctcctgcaggtctagtcagagcctcctccattcaaacgggtacaactatttggattggtacctgcagaagccagggcagtctccacagctcctgatctatgatgcctcttcccttcagtccggggtccctgacaggttcagtggcagtggatcaggcacagattttacactgaaaatcagcagagtggaggctgaggatgttggggtttattactgcatgcaagctcggcaaactcctctgaccttcggccaagggacacgactggagattaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 183 - DNA, 2217 bp, Artificial Sequence
  NK77.50_CD70_DB03_E09 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctggggcctcagtgaaggtttcctgcaaggcatctggatacaccttcaccgcgtactatatgcactgggtgcgacaggcccctggacaagggcttgagtggatgggatggatgaaccccaatagtggtaacacaggatacgcacagaagttccagggcagagtcaccatgaccagggacacgtccacgagcacagtctacatggagctgagcagcctgagatctgaggacacggccgtgtattactgtgctagagagggcagaatcgattacggggactacgacgactactactattactacggtatggacgtgtggggccaagggaccactgtcaccgtctcctcaggtggaggcggttcaggcggaggtggctctggcggtggcggatcggatattgtgatgactcagtctccactctccctgcccgtcacccctggagagccggcctccatctcctgcaggtctagtcagagcctcctgcattcaaatggttacaactatttggattggtacctgcagaagccagggcagtctccacagctcctgatctatgctgcttctaatttacagggtggggtccctgacaggttcagtggcagtggatcaggcacagattttacactgaaaatcagcagagtggaggctgaggatgttggggtttattactgcatgcaaacactagagtcccctgtaactttcggcggagggaccaaggtggagatcaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 184 - DNA, 2175 bp, Artificial Sequence
  NK77.51_CD70_DB03_F02 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctggggcctcagtgaaggtttcctgcaaggcatctggatacaccttcaccgattactatgtgcactgggtgcgacaggcccctggacaagggcttgagtggatgggaacgatcaaccctagtggtgggagcacaagctacgcacagaagttccagggcagagtcaccatgaccagggacacgtccacgagcacagtctacatggagctgagcagcctgagatctgaggacacggccgtgtattactgtgctagagaccagggactctggttcaccggttttgactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccgggcaagtcagggcattagcaacaatttaaattggtatcagcagaaaccagggaaagcccctaagctcctgatctatgatgcatccaacttggaacgtggggtcccatcaaggttcagtggcagtggatctgggacagatttcactctcaccatcagcagtctgcaacctgaagattttgcaacttactactgtcaacagagttacgacggtcctatcaccttcggccaagggacacgactggagattaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 185 - DNA, 2175 bp, Artificial Sequence
  NK77.52_CD70_DB03_F05 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctggggcctcagtgaaggtttcctgcaaggcatctggatacaccttcaccgcctaccacatgcactgggtgcgacaggcccctggacaagggcttgagtggatgggaataatcaaccctggagacggtgccacagggtacgcacagaatctccagggcagagtcaccatgaccagggacacgtccacgagcacagtctacatggagctgagcagcctgagatctgaggacacggccgtgtattactgtgctggtgagggcatttccggatcagatgcttttgatatctggggccaagggacattagtcaccgtctcttcaggtggaggcggttcaggcggaggtggctctggcggtggcggatcggacatccagatgacccagtctccatcctccctgtctgcatctgtaggagacagagtcaccatcacttgccgggcaagtcagagcattagcagctggttagcttggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtttgcaggactacagttatcctctcactttcggcggagggaccaaggtggagatcaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 186 - DNA, 2169 bp, Artificial Sequence
  NK77.53_CD70_DB03_F06 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggatggatgaatcctaactctggtaacacaggttacgcacagaagttccagggcagagtcacgattaccgcggacgaatccacgagcacagcctacatggagctgagcagcctgagatctgaggacacggccgtgtattactgtgcgtggggagtcgatccgtactactttgactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccgggcaagtcagagcattaacaggtggttagcgtggtatcagcagaaaccagggaaagcccctaagctcctgatctatgacgcatccaatttggagaccggggtcccatcaaggttcagtggcagtggatctgggacagatttcactctcaccatcagcagtctgcaacctgaagattttgcaacttactactgtcaacagagttacattacccctctcactttcggcggagggaccaaggtggagatcaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 187 - DNA, 2169 bp, Artificial Sequence
  NK77.54_CD70_DB03_F09 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaatattcaacccctccgatggtagcacaagctacgcacagaagttccagggcagagtcaccatgaccagggacacgtccacgagcacagtctacatggagctgagcagcctgagatctgaggacacggccgtgtattactgtgctagagatgttggtgagaccacgttcgacccctggggccagggaaccctggtcaccgtctcctcaggtggaggcggttcaggcggaggtggctctggcggtggcggatcggacatccagatgacccagtctccatcctccctgtctgcatctgtaggagacagagtcaccatcacttgccaggcaagtcaggatattagcaactatttaaattggtatcagcagaaaccagggaaagcccctaagctcctgatctatgacgcatccagtttggaaagtggggtcccatcaaggttcagtggcagtggatctgggacagatttcactctcaccatcagcagtctgcaacctgaagattttgcaacttactactgtcaacagactaatagttttcctatcaccttcggccaagggacacgactggagattaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 188 - DNA, 2184 bp, Artificial Sequence
  NK77.55_CD70_DB03_F12 construct
atggccttaccagtgaccgccttgctcctgccgctggccttgctgctccacgccgccaggccggactacaaagacgatgacgataaaggcggtggtggctctggtggtggcggatcccaggtgcagctcgttcaaagcggcgccgaggtcaagaaaccaggcgctagcgttaaagttagttgtaaagcctccggctatactttcacatcttacggcatttcttgggtacggcaggcaccggggcagggtttggaatggatggggtggatttccgcctataacggccacacaaattacgcgcagaaattccaggggcgcgttacgatgacacgcgatacctctacctctaccgtttatatggaacttagtagtcttcgttcggaggataccgctgtctactattgcgcacgtgacagtgtacggggttgggactactactacggcatgggggtctggggccaagggaccactgtcaccgtctcctcaggtggaggcggttcaggcggaggtggctctggcggtggcggatcggacatccagatgacccagtctccatcctccctgtctgcatctgtaggagacagagtcaccatcacttgccaggcaagtcaggacattagaaacttcttaaattggtatcagcagaaaccagggaaagcccctaagctcctgatctatgctgcatccacgttgcaaagtggggtcccatcaaggttcagtggcagtggatctgggacagatttcactctcaccatcagcagtctgcaacctgaagattttgcaacttactactgtcaacagagttacagtgcccctagcacttttggccaggggaccaagctggagatcaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 189 - DNA, 2175 bp, Artificial Sequence
  NK77.56_CD70_DB03_G06 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctgggtcttcagtgaaggtttcctgcaaggcatctggatacaccttcatcgactactatatgcactgggtgcgacaggcccctggacaagggcttgagtggatgggatggatgaaccctcacagtggtaacagtgataatgcaccgaagttccagggcagagtcaccatcaccgcagacgagtccacgagcacagcatacatggagctgagcagcctgagatctgaggacacggccgtgtattactgtgctagaggttactccggatacgatctgacggctgactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccgggcaagtcagagcattagcaattatttaaattggtatcagcagaaaccagggaaagcccctaagctcctgatctatgacgcatccaacttggagaccggggtcccatcaaggttcagtggcagtggatctgggacagatttcactctcaccatcagcagtctgcaacctgaagattttgcaacttactactgtcaacagagttacagtacccctatcaccttcggccaagggacacgactggagattaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 190 - DNA, 2202 bp, Artificial Sequence
  NK77.57_CD70_DB03_G11 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctggggcctcagtgaaggtctcctgcaaggcttctggatacaccttcaccggccagtatatgcactgggtgcgacaggcccctggacaagggcttgagtggatgggatggatcaacccgaacactggtgacacaaactatgcacagaagtttcagggcagggtcaccatgaccagggacacgtccaccagcacagtatacatggagctgagcagcctgagatctgaagacacggccgtgtattactgtgcgagagacagcgttttcgaggttgaagggggtactgattattattattactacggtatggatgtctggggccaagggacaatggtcaccgtctcttcaggtggaggcggttcaggcggaggtggctctggcggtggcggatcggacatccagatgacccagtctccatcctccctgtctgcatctgtaggagacagagtcaccatcacttgccgggcaagtgaaaccattagcggctggttagcctggtatcagcagaaaccagggaaagcccctaagctcctgatctatgacgcatccaacttggagactggggtcccatcaaggttcagtggcagtggatctgggacagatttcactctcaccatcagcagtctgcaacctgaagattttgcaacttactactgtcaacagagttacagtaccccttggacgttcggccaagggaccaagctggaaatcaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 191 - DNA, 2172 bp, Artificial Sequence
  NK77.58_CD70_DB03_H08 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctggggcctcagtgaaggtttcctgcaaggcatctggatacaccttcaccagctacgacattaattgggtgcgacaggcccctggacaagggcttgagtggatgggagtgatcaaccctagtggtggaggtacaagctacgcacagaagttccagggcagagtcaccatgaccagggacacgtccacgagcacagtctacatggagctgagcagcctgagatctgaggacacggccgtgtattactgtgctagatattctggctatgattgggtgtttgactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccgggcaagtcagggcattggcagctggttagcttggtatcagcagaaaccagggaaagcccctaagctcctgatctatgctgcatccacattgcaaagtggggtcccatcaaggttcagtggcagtggatctgggacagatttcactctcaccatcagcagtctgcaacctgaagattttgcaacttactactgtcaacagagttacagtaccccttggactttcggccctgggaccaaagtggatatcaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 192 - DNA, 2175 bp, Artificial Sequence
  NK77.59_CD70_DB03_H10 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctggggcctcagtgaaggtttcctgcaaggcatctggatacaccttcgctaactactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgctagagatagcggctcctactttggttggttcgacccctggggccagggaaccctggtcaccgtctcctcaggtggaggcggttcaggcggaggtggctctggcggtggcggatcggacatccagatgacccagtctccatcctccctgtctgcatctgtaggagacagagtcaccatcacttgccgggcaagtcagagcattagcagctctttagcatggtatcagcagaaaccagggaaagcccctaagctcctgatctatgatgcatccagtttgcaaagtggggtcccatcaaggttcagtggcagtggatctgggacagatttcactctcaccatcagcagtctgcaacctgaagattttgcaacttactactgtcaacagagttacaacacccctcccactttcggcggagggaccaagctggagatcaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 193 - DNA, 2175 bp, Artificial Sequence
  NK77.60_CD70_DB04_A05 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctggggcctcagtgaaggtttcctgcaaggcatctggatacaccttcaccacatactatatgcactgggtgcgacaggcccctggacaagggcttgagtggatgggaataatcaaccctaccggcggtagcacatactacgcacagaagttccagggcagagtcaccatgaccagggacacgtccacgagcacagtctacatggagctgagcagcctgagatctgaggacacggccgtgtattactgtgctagagacagcgggaactatcaagggatctttgactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccgggcaagtcaggggattggcggctatttagcctggtatcagcagaaaccagggaaagcccctaagctcctgatctatgatgcatccaatttggagaccggggtcccatcaaggttcagtggcagtggatctgggacagatttcactctcaccatcagcagtctgcaacctgaagattttgcaacttactactgtcaacagagttacgactcccctcccaccttcggccaagggacacgactggagattaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 194 - DNA, 2172 bp, Artificial Sequence
  NK77.61_CD70_DB04_A07 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctggggcctcagtgaaggtttcctgcaaggcatctggaaataccttcaccagctactatatgcactgggtgcgacaggcccctggacaagggcttgagtggatgggatggatcaaccccaacagtggtgacacaaattacgcacagaacttccagggcagagtcaccatgaccagggacacgtccacgagcacagtctacatggagctgagcagcctgagatctgaggacacggccgtgtattactgtgctagaggtgtcagcggttacgatctatttgactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccgggcaagtcagagcgtgagcagctatttaaattggtatcagcagaaaccagggaaagcccctaagctcctgatctatgatacgtccaacttggagacgggggtcccatcaaggttcagtggcagtggatctgggacagatttcactctcaccatcagcagtctgcaacctgaagattttgcaacttactactgtcaacaggctcatagttttcctctcactttcggcggagggaccaaggtggagatcaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 195 - DNA, 2172 bp, Artificial Sequence
  NK77.62_CD70_DB04_A10 construct
atggccttaccagtgaccgccttgctcctgccgctggccttgctgctccacgccgccaggccggactacaaagacgatgacgataaaggcggtggtggctctggtggtggcggatccgaggtgcagctggtggagtctgggggaggcttggtcaagcctggggggtccctgagactctcctgtgcagcgtctggattcaccttcagtagctatggcatgcactgggtccgccaggctccaggcaaggggctggagtgggtggcatcgataaaacatgatggaagtgagcaatactatgttgactccgtgaagggccgattcaccatctccagagacgattccaagaacacgctgtatctgcaaatgaacagcctgaaaacggaggacacggctgtgtattactgtgcggctagtggagtggatgtctggggccaagggacaaccgtcaccgtctcttcaggtggaggcggttcaggcggaggtggctctggcggtggcggatcggatattgtgatgactcagtctccactctccctgcccgtcacccctggagagccggcctccatctcctgcaggtctagtcagagcctcctgcacagcaatggctacaactatttggattggtacctgcagaagccagggcagtctccacagctcctgatctatttgggttctacccgggcctccggggtccctgacaggttcagtggcagtggatcaggcacagattttacactgaaaatcagcagagtggaggctgaggatgttggggtttattactgcatgcaagctctagatactcctctcactttcggcggagggaccaagttagagatcaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 196 - DNA, 2181 bp, Artificial Sequence
  NK77.63_CD70_DB04_A11 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctggggcctcagtgaaggtttcctgcaaggcatctggaggtaccttcagtcgttacgacattaattgggtgcgacaggcccctggacaagggcttgagtgggtgggaataatcgatcctacaggtgcgtcaacaagctacgcacagaagttccagggcagagtcaccatgaccagggacacgtccacgagcacagtctacatggagctgagcagcctgagatctgaggacacggccgtgtattactgtgctagagattacagttacgggatggattattatggcatggacgtctggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatacctccaatttgcagacaggggtcccatcaaggttcagtggaagtggatctgggacagattttactcttaccatcagcagcctgcagcctgaagattttgcaacatattacctgagcacagatctgcagaccaccgctcacttcggccaagggaccaaggtggaaatcaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 197 - DNA, 2187 bp, Artificial Sequence
  NK77.64_CD70_DB04_B03 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctgggtcctcggtgaaggtctcctgcaaggcttctggatacaccttcaccagctatggaatcagctgggtgcgacaggcccctggacaagggcttgagtggatgggaggtatcatccctatctttggtacaacgaactacgcacagaagttccagggcagagtcacgattaccgcggacgaatccacgagcacagcctacatggagctgagcagcctgagatctgaggacacggccgtgtattactgtgcgagagatcatagcggcgatgggtacttcgatctctggggccgtggcaccctggtcactgtctcctcaggtggaggcggttcaggcggaggtggctctggcggtggcggatcggatattgtgatgactcagtctccactctccctgcccgtcacccctggagagccggcctccatctcctgcaggtctagtcagagcctcctgcactccaacggatacaactatttggattggtacctgcagaagccagggcagtctccacagctcctgatctatgatgcctcttcacttcagtccggggtccctgacaggttcagtggcagtggatcaggcacagattttacactgaaaatcagcagagtggaggctgaggatgttggggtttattactgcatgcaaggaacacactggcctcccacgttcggccaagggaccaaggtggaaatcaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 198 - DNA, 2169 bp, Artificial Sequence
  NK77.65_CD70_DB04_B05 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctggggcctcagtgaaggtctcctgcaaggcttctggatacaccttcaccgagaatgagatgcactgggtgcgacaggcccctggacaagggcttgagtggatgggatggatcaacccgaacagtggtggcacaaactatgcacagaagtttcagggcagggtcaccatgaccagggacacgtccactagcacagtgtacatggagctgagctctctgagatctgaagacacggccgtgtattactgtgcggggagctggggtggttactactttgactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccgggcaagtcagagcgttagcagatatttaaattggtatcagcagaaaccagggaaagcccctaagctcctgatctatgatgcatccaatttggaaaccggggtcccatcaaggttcagtggcagtggatctgggacagatttcactctcaccatcagcagtctgcaacctgaagattttgcaacttactactgtcaacaggccgacagtttccctgtgacttttggccaggggaccaagctggagatcaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 199 - DNA, 2178 bp, Artificial Sequence
  NK77.66_CD70_DB04_B07 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctggggcctcagtgaaggtttcctgcaaggcatctggatacaccttcaccaactactatatctactgggtgcgacaggcccctggacaagggcttgagtggatgggatggatcaaccccaatgacggtgcaacaaattacgcacagaagttccagggcagagtcaccatgaccagggacacgtccacgagcacagtctacatggagctgagcagcctgagatctgaggacacggccgtgtattactgtgctagagaaggcaacgattactattattatttcatggactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccgggcaagtcagggcattagcaacaatttaaattggtatcagcagaaaccagggaaagcccctaagctcctgatctatcatgcatccaacttggagacgggggtcccatcaaggttcagtggcagtggatctgggacagatttcactctcaccatcagcagtctgcaacctgaagattttgcaacttactactgtcaacagagttacgacggccctatgacttttggccaggggaccaagctggagatcaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 200 - DNA, 2196 bp, Artificial Sequence
  NK77.67_CD70_DB04_C01 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggaggaatcacaccaatgtttggtacaacggactacgcacagaagttccagggcagagtcacgattaccgcggacgaatccacgagcacagcctacatggagctgagcagcctgagatctgaggacacggccgtgtattactgtgcgagagatgagcgggacggatacgccacagtggcttttgatatctggggccaagggacaatggtcaccgtctcttcaggtggaggcggttcaggcggaggtggctctggcggtggcggatcggatattgtgatgactcagtctccactctccctgcccgtcacccctggagagccggcctccatctcctgcaggtctagtcagagcctcctgcatagcaatggatacaactatttggattggtacctgcagaagccagggcagtctccacagctcctgatctatgatgcttctaatcttgagacaggggtccctgacaggttcagtggcagtggatcaggcacagattttacactgaaaatcagcagagtggaggctgaggatgttggggtttattactgcatgcaagggacgcattggcctcccacgttcggccaagggaccaaggtggaaatcaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 201 - DNA, 2181 bp, Artificial Sequence
  NK77.68_CD70_DB04_C04 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtgacggaggaacaagctacgcagacaagttccagggcagagtcaccatgaccagggacacgtccacgagcacagtctacatggagctgagcagcctgagatctgaggacacggccgtgtattactgtgctagagcgcttgcccccctgggatggggtgacggcatggatgtctggggccaagggacaacagtcaccgtctcttcaggtggaggcggttcaggcggaggtggctctggcggtggcggatcggacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactctcaccatcagcagcctgcagcctgaagatttcgcaacatattactgtcaacagtcatatgatggacctatcaccttcggccaagggacacgactggagattaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 202 - DNA, 2172 bp, Artificial Sequence
  NK77.69_CD70_DB04_C06 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctgggtcctcggtgaaggtctcctgcaaggcttctggatacaccttcactagctattacatccactgggtgcgacaggcccctggacaagggcttgagtggatgggatggatgaatccctcctcaggtgttacgaacttcgcacagaagttccagggcagagtcacgattaccgcggacgaatccacgagcacagcctacatggagctgagcagcctgagatctgaggacacggccgtgtattactgtgcgagaggttcggaccagggtgactggtctgacccctggggccagggaaccctggtcaccgtctcctcaggtggaggcggttcaggcggaggtggctctggcggtggcggatcggacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgacgcatccaacttggaaacgggggtcccatcaaggttcagtggcagtggatctgggacagatttcactctcaccatcagcagtctgcaacctgaagattttgcaacttactactgtcaacagagttacaatacccctccaactttcggcggagggaccaaggtggagatcaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 203 - DNA, 2181 bp, Artificial Sequence
  NK77.70_CD70_DB04_C07 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctggggcctcagtgaaggtttcctgcaaggcatctggatacaccttcaccgactcctatatacactgggtgcgacaggcccctggacaagggcttgagtggattggatggatgaaccctaatacaggtgacacaggctacgcacagaagttccagggcagagtcaccatgaccagggacacgtccacgagcacagtctacatggagctgagcagcctgagatctgaggacacggccgtgtattactgtgctaaggacgactttggagagcttgctccagccaccttcgacccctggggccagggaaccctggtcaccgtctcctcaggtggaggcggttcaggcggaggtggctctggcggtggcggatcggacatccagatgacccagtctccatcctccctgtctgcatctgtaggagacagagtcaccatcacttgccaggcaagtcaggacattagcaattatttaaattggtatcagcagaaaccagggaaagcccctaagctcctgatctatggtgcatccagtttgcaaagtggggtcccatcaaggttcagtggcagtggatctgggacagatttcactctcaccatcagcagtctgcaacctgaagattttgcaacttactactgtctgcaggatgcggcgacccctatcaccttcggccaagggacacgactggagattaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 204 - DNA, 2181 bp, Artificial Sequence
  NK77.71_CD70_DB04_D02 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctggggcctcagtgaaggtttcctgcaaggcatctggatacaccttcaccagctacgacatcaattgggtgcgacaggcccctggacaagggcttgagtggatgggagtcatcagccctagtggtggtggaacaagctacgcacagaagttccagggcagagtcaccatgaccagggacacgtccacgagcacagtctacatggagctgagcagcctgagatctgaggacacggccgtgtattactgtgctagatactacggcggcaaccccgaagggtggtacttcgatctctggggccgtggcaccctggtcactgtctcctcaggtggaggcggttcaggcggaggtggctctggcggtggcggatcggacatccagatgacccagtctccatcctccctgtctgcatctgtaggagacagagtcaccatcacttgccgggcaagtcagagcattggaaattggttagcctggtatcagcagaaaccagggaaagcccctaagctcctgatctatgacgcatccgatttggaaaccggggtcccatcaaggttcagtggcagtggatctgggacagatttcactctcaccatcagcagtctgcaacctgaagattttgcaacttactactgtcaacagagttacactaccccttggacgttcggccaagggaccaaggtggaaatcaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 205 - DNA, 2226 bp, Artificial Sequence
  NK77.72_CD70_DB04_D05 construct
atggccttaccagtgaccgccttgctcctgccgctggccttgctgctccacgccgccaggccggactacaaagacgatgacgataaaggcggtggtggctctggtggtggcggatccgaggtgcagctgctggagtctgggggaggcctcgtccagcctgggggctccctgagactctcctgtgcagcctctggattcgttttcgatgactatgctatccactgggtccgccaggctccgggcaaggggctagagtgggtggcagcgatatcatatgatggaagtaataaatactacgcagactccgtgaagggccgattcaccatctccagagacaattccaagaacacgctgtatctgcaaatgaacagcctgagagctgaggacacggctgtgtattactgtgcgagagctccacaatattatgggagtggcaccgacccacttgaggttagatactactactacggcatggacgtgtggggccaagggaccacggtcaccgtctcctcaggtggaggcggttcaggcggaggtggctctggcggtggcggatcggatattgtgatgactcagtctccactctccctgcccgtcacccctggagagccggcctccatctcctgcaggtctagtcagagcctcttgcattctaatggctacaactatttggattggtacctgcagaagccagggcagtctccacagctcctgatctatgaagtctctaatcgggcctccggggtccctgacaggttcagtggcagtggatcaggcacagattttacactgaaaatcagcagagtggaggctgaggatgttggggtttattactgcatgaaaggcctacaaactcctctgactttcggccctgggaccaaagtggatatcaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 206 - DNA, 2181 bp, Artificial Sequence
  NK77.73_CD70_DB04_D07 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctgggtcctcggtgaaggtctcctgcaaggcttctggaggcaccttccgcaattatgctatcagctgggtgcgacaggcccctggacaagggcttgagtggatgggaggtatcatccctatctttggtacagcaaactacgcacagaagttccagggcagagtcacgattaccgcggacgaatccacgagcacagcctacatggagctgagcagcctgagatctgaggacacggccgtgtattactgtgcgagagatcacagtgctgggactcaccacgacgcttttgatatctggggccaagggacaatggtcaccgtctcttcaggtggaggcggttcaggcggaggtggctctggcggtggcggatcggacatccagatgacccagtctccatcctccctgtctgcatctgtaggagacagagtcaccatcacttgccgggcaagtcagggcattagcaactatttagcctggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagtcacagtacccctctcactttcggccaagggaccaaggtggagatcaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 207 - DNA, 2166 bp, Artificial Sequence
  NK77.74_CD70_DB04_D08 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctggggcctcagtgaaggtctcctgcaaggcttctggatacaccttcaccagttattatatccactgggtgcgacaggccccgggacaagggcttgagtggatgggatggatgaacccaaacagtggtaacgccggctatgcacagaagttccagggcagagtcaccatgaccagggatacctccacaagcacagtgtacatggagctgagcagcctgagatctgaggacacggccgtgtattactgtgcgagagagtactgggggagctttgactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccgggcaagtcaggggattagcaataacttaaattggtatcagcagaaaccagggaaagcccctaagctcctgatctatgatgcatccaacttggaaactggggtcccatcaaggttcagtggcagtggatctgggacagatttcactctcaccatcagcagtctgcaacctgaagattttgcaacttactactgtcaacagagttacagtaccccttatacgttcggccaagggaccaaggtggaaatcaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 208 - DNA, 2169 bp, Artificial Sequence
  NK77.75_CD70_DB04_D10 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctggggcctcagtgaaggtttcctgcaaggcatctggatacaccttcaccggctactatatgcactgggtgcgacaggcccctggacaagggcttgagtggatgggaatgatcgatccaagcgacggtagcacaatttacgcacagaagttccagggcagagtcaccatgaccagggacacgtccacgagcacagtctacatggagctgagcagcctgagatctgaggacacggccgtgtattactgtgctagagagcggccactgtacgcttccgacctgtggggccaagggaccctggtcaccgtctcctcaggtggaggcggttcaggcggaggtggctctggcggtggcggatcggatatccagatgacccagtctccatcctccctgtctgcatctgtaggagacagagtcaccatcacttgccgggcaagtcaggacattggaaatgatttaggctggtatcagcagaaaccagggaaagcccctaagctcctgatctatgctgcatccagtttacaaagtggggtcccatcaaggttcagcggcagtggatctggcacagatttcactctcaccatcagcagcctgcagcctgaagattttgcaacttattactgtctacaagattacgactaccctctcactttcggccaggggaccaaggtggagatcaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 209 - DNA, 2172 bp, Artificial Sequence
  NK77.85_CD70_DB03_B02 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctgggtcttcagtgaaggtttcctgcaaggcatctggatacaccttcaccaactactatatgcactgggtgcgacaggcccctggacaagggcttgagtggatgggatggatgaaccccgatagtggtaatacagggtacgcacagaagttccagggcagagtcaccatcaccgctgacgaatccacgagcacagcctacatggagctgagcagcctgagatctgaggacacggccgtgtattactgtgctagaagtagcagctcctggcctgacttcgatctctggggccgtggcaccctggtcactgtctcctcaggtggaggcggttcaggcggaggtggctctggcggtggcggatcggacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgatgcatccaacttggagactggggtcccatcaaggttcagtggcagtggatctgggacagatttcactctcaccatcagcagtctgcaacctgaagattttgcaacttactactgtcaacagagttacaacaccccttacagttttggccaggggaccaaggtggagatcaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 210 - DNA, 2175 bp, Artificial Sequence
  NK77.86_CD70_DB04_A06 construct
atggccttaccagtgaccgccttgctcctgccgctggccttgctgctccacgccgccaggccggactacaaagacgatgacgataaaggcggtggtggctctggtggtggcggatcccaggtccaactcgtacaatccggcgcagaagtcaaaaaacccggcgcaagcgtcaaggtatcatgtaaagctagcgggtatacatttacatcctattccatgcattgggtacgccaagctccaggccagggcctggaatgggtcggtatcattaatcccagttccggctctgccagttatgcgcaaaaatttcaaggaagggtgacaatgactcgagataccagtacctccactgtgtatatggaactgtcctcactaaggagcgaagatactgctgtatactactgcgcacgcgaacgtggggcctatagtagtaccttcgactattggggtcagggcacgttagtgacagtgtcttccggtggaggcggttcaggcggaggtggctctggcggtggcggatcggacatccagatgacccagtctccatcctccctgtctgcatctgtaggagacagagtcaccatcacttgccggacaagtcagagcattagcagctatttaaattggtatcagcagaaaccagggaaagcccctaagctcctgatctatgacgcatccaatttggaaaccggggtcccatcaaggttcagtggcagtggatctgggacagatttcactctcaccatcagcagtctgcaacctgaagattttgcaacttactactgtcttcaggactacagttaccctctcactttcggccaagggaccaaggtggagatcaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 211 - DNA, 2175 bp, Artificial Sequence
  NK77.87_CD70_DB04_A09 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctggggcctcagtgaaggtttcctgcaaggcatctggatacaccttcaccgactactatatgcactgggtgcgacaggcccctggacaagggcttgagtggatgggagtcatcaacccctctgatggtacagctcattacgcacagcggctgcagggcagagtcaccatgaccagggacacgtccacgagcacagtctacatggagctgagcagcctgagatctgaggacacggccgtgtattactgtgctagagacagcggatcttactacgctgactttgactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccaggcaagtcaggacattagcaattatttaaattggtatcagcagaaaccagggaaagcccctaagctcctgatctatgatgcatccagtttgcaaagtggggtcccatcaaggttcagtggcagtggatctgggacagatttcactctcaccatcagcagtctgcaacctgaagattttgcaacttactactgtcaacagagttacagtacccctcccgccttcggccaagggaccaaggtggaaatcaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 212 - DNA, 2970 bp, Artificial Sequence
  NK77.76_38-38 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctggggcctcagtgaaggtttcctgcaaggcatctggatacagtttcaccagctactatatgcactgggtgcgacaggcccctggacaagggcttgagtggatgggaataatcaaccctagtggtgggactacaagctacgcacagaagttccagggcagagtcaccatgaccagggacacgtccacgagcacagtctacatggagctgagcagcctgagatctgaggacacggccgtgtattactgtgctagagacaattccccgtatagctcaagctggtgggactactttgactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccgggcaagtcaggacattcggcattatttagcatggtatcagcagaaaccagggaaagcccctaagctcctgatctatgacgcatccagtttgcaaagtggggtcccatcaaggttcagtggcagtggatctgggacagatttcactctcaccatcagcagtctgcaacctgaagattttgcaacttactactgtcaacagacctacgacgcacctatcaccttcggccaagggacacgactggagattaaaggtggcggtggctcgggcggtggtgggtcgggtggcggcggatctcaggtgcagctggtgcagtctggggctgaggtgaagaagcctggggcctcagtgaaggtttcctgcaaggcatctggatacagtttcaccagctactatatgcactgggtgcgacaggcccctggacaagggcttgagtggatgggaataatcaaccctagtggtgggactacaagctacgcacagaagttccagggcagagtcaccatgaccagggacacgtccacgagcacagtctacatggagctgagcagcctgagatctgaggacacggccgtgtattactgtgctagagacaattccccgtatagctcaagctggtgggactactttgactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccgggcaagtcaggacattcggcattatttagcatggtatcagcagaaaccagggaaagcccctaagctcctgatctatgacgcatccagtttgcaaagtggggtcccatcaaggttcagtggcagtggatctgggacagatttcactctcaccatcagcagtctgcaacctgaagattttgcaacttactactgtcaacagacctacgacgcacctatcaccttcggccaagggacacgactggagattaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 213 - DNA, 2970 bp, Artificial Sequence
  NK77.77_64-64 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctgggtcctcggtgaaggtctcctgcaaggcttctggatacaccttcaccagctatggaatcagctgggtgcgacaggcccctggacaagggcttgagtggatgggaggtatcatccctatctttggtacaacgaactacgcacagaagttccagggcagagtcacgattaccgcggacgaatccacgagcacagcctacatggagctgagcagcctgagatctgaggacacggccgtgtattactgtgcgagagatcatagcggcgatgggtacttcgatctctggggccgtggcaccctggtcactgtctcctcaggtggaggcggttcaggcggaggtggctctggcggtggcggatcggatattgtgatgactcagtctccactctccctgcccgtcacccctggagagccggcctccatctcctgcaggtctagtcagagcctcctgcactccaacggatacaactatttggattggtacctgcagaagccagggcagtctccacagctcctgatctatgatgcctcttcacttcagtccggggtccctgacaggttcagtggcagtggatcaggcacagattttacactgaaaatcagcagagtggaggctgaggatgttggggtttattactgcatgcaaggaacacactggcctcccacgttcggccaagggaccaaggtggaaatcaaaggtggcggtggctcgggcggtggtgggtcgggtggcggcggatctcaggtgcagctggtgcagtctggggctgaggtgaagaagcctgggtcctcggtgaaggtctcctgcaaggcttctggatacaccttcaccagctatggaatcagctgggtgcgacaggcccctggacaagggcttgagtggatgggaggtatcatccctatctttggtacaacgaactacgcacagaagttccagggcagagtcacgattaccgcggacgaatccacgagcacagcctacatggagctgagcagcctgagatctgaggacacggccgtgtattactgtgcgagagatcatagcggcgatgggtacttcgatctctggggccgtggcaccctggtcactgtctcctcaggtggaggcggttcaggcggaggtggctctggcggtggcggatcggatattgtgatgactcagtctccactctccctgcccgtcacccctggagagccggcctccatctcctgcaggtctagtcagagcctcctgcactccaacggatacaactatttggattggtacctgcagaagccagggcagtctccacagctcctgatctatgatgcctcttcacttcagtccggggtccctgacaggttcagtggcagtggatcaggcacagattttacactgaaaatcagcagagtggaggctgaggatgttggggtttattactgcatgcaaggaacacactggcctcccacgttcggccaagggaccaaggtggaaatcaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 214 - DNA, 2934 bp, Artificial Sequence
  NK77.78_65-65 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctggggcctcagtgaaggtctcctgcaaggcttctggatacaccttcaccgagaatgagatgcactgggtgcgacaggcccctggacaagggcttgagtggatgggatggatcaacccgaacagtggtggcacaaactatgcacagaagtttcagggcagggtcaccatgaccagggacacgtccactagcacagtgtacatggagctgagctctctgagatctgaagacacggccgtgtattactgtgcggggagctggggtggttactactttgactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccgggcaagtcagagcgttagcagatatttaaattggtatcagcagaaaccagggaaagcccctaagctcctgatctatgatgcatccaatttggaaaccggggtcccatcaaggttcagtggcagtggatctgggacagatttcactctcaccatcagcagtctgcaacctgaagattttgcaacttactactgtcaacaggccgacagtttccctgtgacttttggccaggggaccaagctggagatcaaaggtggcggtggctcgggcggtggtgggtcgggtggcggcggatctcaggtgcagctggtgcagtctggggctgaggtgaagaagcctggggcctcagtgaaggtctcctgcaaggcttctggatacaccttcaccgagaatgagatgcactgggtgcgacaggcccctggacaagggcttgagtggatgggatggatcaacccgaacagtggtggcacaaactatgcacagaagtttcagggcagggtcaccatgaccagggacacgtccactagcacagtgtacatggagctgagctctctgagatctgaagacacggccgtgtattactgtgcggggagctggggtggttactactttgactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccgggcaagtcagagcgttagcagatatttaaattggtatcagcagaaaccagggaaagcccctaagctcctgatctatgatgcatccaatttggaaaccggggtcccatcaaggttcagtggcagtggatctgggacagatttcactctcaccatcagcagtctgcaacctgaagattttgcaacttactactgtcaacaggccgacagtttccctgtgacttttggccaggggaccaagctggagatcaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 215 - DNA, 2979 bp, Artificial Sequence
  NK77.79_38-67 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctggggcctcagtgaaggtttcctgcaaggcatctggatacagtttcaccagctactatatgcactgggtgcgacaggcccctggacaagggcttgagtggatgggaataatcaaccctagtggtgggactacaagctacgcacagaagttccagggcagagtcaccatgaccagggacacgtccacgagcacagtctacatggagctgagcagcctgagatctgaggacacggccgtgtattactgtgctagagacaattccccgtatagctcaagctggtgggactactttgactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccgggcaagtcaggacattcggcattatttagcatggtatcagcagaaaccagggaaagcccctaagctcctgatctatgacgcatccagtttgcaaagtggggtcccatcaaggttcagtggcagtggatctgggacagatttcactctcaccatcagcagtctgcaacctgaagattttgcaacttactactgtcaacagacctacgacgcacctatcaccttcggccaagggacacgactggagattaaaggtggcggtggctcgggcggtggtgggtcgggtggcggcggatctcaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggaggaatcacaccaatgtttggtacaacggactacgcacagaagttccagggcagagtcacgattaccgcggacgaatccacgagcacagcctacatggagctgagcagcctgagatctgaggacacggccgtgtattactgtgcgagagatgagcgggacggatacgccacagtggcttttgatatctggggccaagggacaatggtcaccgtctcttcaggtggaggcggttcaggcggaggtggctctggcggtggcggatcggatattgtgatgactcagtctccactctccctgcccgtcacccctggagagccggcctccatctcctgcaggtctagtcagagcctcctgcatagcaatggatacaactatttggattggtacctgcagaagccagggcagtctccacagctcctgatctatgatgcttctaatcttgagacaggggtccctgacaggttcagtggcagtggatcaggcacagattttacactgaaaatcagcagagtggaggctgaggatgttggggtttattactgcatgcaagggacgcattggcctcccacgttcggccaagggaccaaggtggaaatcaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 216 - DNA, 2964 bp, Artificial Sequence
  NK77.80_38-68 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctggggcctcagtgaaggtttcctgcaaggcatctggatacagtttcaccagctactatatgcactgggtgcgacaggcccctggacaagggcttgagtggatgggaataatcaaccctagtggtgggactacaagctacgcacagaagttccagggcagagtcaccatgaccagggacacgtccacgagcacagtctacatggagctgagcagcctgagatctgaggacacggccgtgtattactgtgctagagacaattccccgtatagctcaagctggtgggactactttgactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccgggcaagtcaggacattcggcattatttagcatggtatcagcagaaaccagggaaagcccctaagctcctgatctatgacgcatccagtttgcaaagtggggtcccatcaaggttcagtggcagtggatctgggacagatttcactctcaccatcagcagtctgcaacctgaagattttgcaacttactactgtcaacagacctacgacgcacctatcaccttcggccaagggacacgactggagattaaaggtggcggtggctcgggcggtggtgggtcgggtggcggcggatctcaggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtgacggaggaacaagctacgcagacaagttccagggcagagtcaccatgaccagggacacgtccacgagcacagtctacatggagctgagcagcctgagatctgaggacacggccgtgtattactgtgctagagcgcttgcccccctgggatggggtgacggcatggatgtctggggccaagggacaacagtcaccgtctcttcaggtggaggcggttcaggcggaggtggctctggcggtggcggatcggacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactctcaccatcagcagcctgcagcctgaagatttcgcaacatattactgtcaacagtcatatgatggacctatcaccttcggccaagggacacgactggagattaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 217 - DNA, 2979 bp, Artificial Sequence
  NK77.81_64-67 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctgggtcctcggtgaaggtctcctgcaaggcttctggatacaccttcaccagctatggaatcagctgggtgcgacaggcccctggacaagggcttgagtggatgggaggtatcatccctatctttggtacaacgaactacgcacagaagttccagggcagagtcacgattaccgcggacgaatccacgagcacagcctacatggagctgagcagcctgagatctgaggacacggccgtgtattactgtgcgagagatcatagcggcgatgggtacttcgatctctggggccgtggcaccctggtcactgtctcctcaggtggaggcggttcaggcggaggtggctctggcggtggcggatcggatattgtgatgactcagtctccactctccctgcccgtcacccctggagagccggcctccatctcctgcaggtctagtcagagcctcctgcactccaacggatacaactatttggattggtacctgcagaagccagggcagtctccacagctcctgatctatgatgcctcttcacttcagtccggggtccctgacaggttcagtggcagtggatcaggcacagattttacactgaaaatcagcagagtggaggctgaggatgttggggtttattactgcatgcaaggaacacactggcctcccacgttcggccaagggaccaaggtggaaatcaaaggtggcggtggctcgggcggtggtgggtcgggtggcggcggatctcaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggaggaatcacaccaatgtttggtacaacggactacgcacagaagttccagggcagagtcacgattaccgcggacgaatccacgagcacagcctacatggagctgagcagcctgagatctgaggacacggccgtgtattactgtgcgagagatgagcgggacggatacgccacagtggcttttgatatctggggccaagggacaatggtcaccgtctcttcaggtggaggcggttcaggcggaggtggctctggcggtggcggatcggatattgtgatgactcagtctccactctccctgcccgtcacccctggagagccggcctccatctcctgcaggtctagtcagagcctcctgcatagcaatggatacaactatttggattggtacctgcagaagccagggcagtctccacagctcctgatctatgatgcttctaatcttgagacaggggtccctgacaggttcagtggcagtggatcaggcacagattttacactgaaaatcagcagagtggaggctgaggatgttggggtttattactgcatgcaagggacgcattggcctcccacgttcggccaagggaccaaggtggaaatcaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 218 - DNA, 2964 bp, Artificial Sequence
  NK77.82_64-68 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctgggtcctcggtgaaggtctcctgcaaggcttctggatacaccttcaccagctatggaatcagctgggtgcgacaggcccctggacaagggcttgagtggatgggaggtatcatccctatctttggtacaacgaactacgcacagaagttccagggcagagtcacgattaccgcggacgaatccacgagcacagcctacatggagctgagcagcctgagatctgaggacacggccgtgtattactgtgcgagagatcatagcggcgatgggtacttcgatctctggggccgtggcaccctggtcactgtctcctcaggtggaggcggttcaggcggaggtggctctggcggtggcggatcggatattgtgatgactcagtctccactctccctgcccgtcacccctggagagccggcctccatctcctgcaggtctagtcagagcctcctgcactccaacggatacaactatttggattggtacctgcagaagccagggcagtctccacagctcctgatctatgatgcctcttcacttcagtccggggtccctgacaggttcagtggcagtggatcaggcacagattttacactgaaaatcagcagagtggaggctgaggatgttggggtttattactgcatgcaaggaacacactggcctcccacgttcggccaagggaccaaggtggaaatcaaaggtggcggtggctcgggcggtggtgggtcgggtggcggcggatctcaggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtgacggaggaacaagctacgcagacaagttccagggcagagtcaccatgaccagggacacgtccacgagcacagtctacatggagctgagcagcctgagatctgaggacacggccgtgtattactgtgctagagcgcttgcccccctgggatggggtgacggcatggatgtctggggccaagggacaacagtcaccgtctcttcaggtggaggcggttcaggcggaggtggctctggcggtggcggatcggacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactctcaccatcagcagcctgcagcctgaagatttcgcaacatattactgtcaacagtcatatgatggacctatcaccttcggccaagggacacgactggagattaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 219 - DNA, 2961 bp, Artificial Sequence
  NK77.83_65-67 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctggggcctcagtgaaggtctcctgcaaggcttctggatacaccttcaccgagaatgagatgcactgggtgcgacaggcccctggacaagggcttgagtggatgggatggatcaacccgaacagtggtggcacaaactatgcacagaagtttcagggcagggtcaccatgaccagggacacgtccactagcacagtgtacatggagctgagctctctgagatctgaagacacggccgtgtattactgtgcggggagctggggtggttactactttgactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccgggcaagtcagagcgttagcagatatttaaattggtatcagcagaaaccagggaaagcccctaagctcctgatctatgatgcatccaatttggaaaccggggtcccatcaaggttcagtggcagtggatctgggacagatttcactctcaccatcagcagtctgcaacctgaagattttgcaacttactactgtcaacaggccgacagtttccctgtgacttttggccaggggaccaagctggagatcaaaggtggcggtggctcgggcggtggtgggtcgggtggcggcggatctcaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggaggaatcacaccaatgtttggtacaacggactacgcacagaagttccagggcagagtcacgattaccgcggacgaatccacgagcacagcctacatggagctgagcagcctgagatctgaggacacggccgtgtattactgtgcgagagatgagcgggacggatacgccacagtggcttttgatatctggggccaagggacaatggtcaccgtctcttcaggtggaggcggttcaggcggaggtggctctggcggtggcggatcggatattgtgatgactcagtctccactctccctgcccgtcacccctggagagccggcctccatctcctgcaggtctagtcagagcctcctgcatagcaatggatacaactatttggattggtacctgcagaagccagggcagtctccacagctcctgatctatgatgcttctaatcttgagacaggggtccctgacaggttcagtggcagtggatcaggcacagattttacactgaaaatcagcagagtggaggctgaggatgttggggtttattactgcatgcaagggacgcattggcctcccacgttcggccaagggaccaaggtggaaatcaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 220 - DNA, 2946 bp, Artificial Sequence
  NK77.84_65-68 construct
atggccttaccagtgaccgccttgctcctgccgctggccttgctgctccacgccgccaggccggactacaaagacgatgacgataaaggcggtggtggctctggtggtggcggatcccaggtgcagctggtgcagtctggggctgaggtgaagaagcctggggcctcagtgaaggtctcctgcaaggcttctggatacaccttcaccgagaatgagatgcactgggtgcgacaggcccctggacaagggcttgagtggatgggatggatcaacccgaacagtggtggcacaaactatgcacagaagtttcagggcagggtcaccatgaccagggacacgtccactagcacagtgtacatggagctgagctctctgagatctgaagacacggccgtgtattactgtgcggggagctggggtggttactactttgactactggggccaagggaccctggtcaccgtctcctcaggtggaggcggttcaggcggaggtggctctggcggtggcggatcggacatccagatgacccagtctccatcctccctgtctgcatctgtaggagacagagtcaccatcacttgccgggcaagtcagagcgttagcagatatttaaattggtatcagcagaaaccagggaaagcccctaagctcctgatctatgatgcatccaatttggaaaccggggtcccatcaaggttcagtggcagtggatctgggacagatttcactctcaccatcagcagtctgcaacctgaagattttgcaacttactactgtcaacaggccgacagtttccctgtgacttttggccaggggaccaagctggagatcaaaggtggcggtggctcgggcggtggtgggtcgggtggcggcggatctcaggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtgacggaggaacaagctacgcagacaagttccagggcagagtcaccatgaccagggacacgtccacgagcacagtctacatggagctgagcagcctgagatctgaggacacggccgtgtattactgtgctagagcgcttgcccccctgggatggggtgacggcatggatgtctggggccaagggacaacagtcaccgtctcttcaggtggaggcggttcaggcggaggtggctctggcggtggcggatcggacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactctcaccatcagcagcctgcagcctgaagatttcgcaacatattactgtcaacagtcatatgatggacctatcaccttcggccaagggacacgactggagattaaaaccacgacgccagcgccgcggccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgccggagggaccagaggctgccccccgatgcccacaagccccctgggggaggcagtttccggacccccatccaagaggagcaggccgacgcccactccaccctggccaagatcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggctctggcgagggaaggggttccctgcttacttgcggcgacgtcgaagagaatcccggtccgatggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgctaa

SEQ ID NO: 221 - DNA, 1521 bp, Artificial Sequence
  NK77.76_38-38 scFv codon optimized
caggtgcagctggttcagtccggggccgaagtcaagaagcctggcgcatctgtgaaggtgtcctgtaaagctagcggctactccttcaccagctactacatgcattgggtccgccaggcgccgggacaaggcctggagtggatggggattattaacccctcaggagggacgaccagctacgcgcagaaatttcagggccgcgtaaccatgacgcgcgacacctccacctccaccgtctacatggagctctcctcgcttagatccgaggacaccgccgtgtactactgcgctcgcgacaactccccttactctagtagttggtgggactacttcgactactggggccagggcaccctagttacagtctcctcgggtggtggcggctccggtggcggcggctccggaggtggcggctccgacatccagatgacccagtcgccatcgagcctttcagcttcggtcggggacagggtgactatcacctgccgagcgtcccaggacatccgtcactacctggcctggtatcagcagaagcccggtaaggcacccaagttgctcatctacgacgccagctcgctgcagagcggtgtgccctctcgttttagcggttccggcagcggcaccgacttcaccctgaccatctcttccctgcagccggaggatttcgctacctactactgtcaacagacttacgacgcacccatcaccttcggccagggcactcgactggagatcaagggcggcggcggttctggtgggggcgggtctggcgggggcggtagtcaggtgcaattagtgcagtctggcgccgaggtgaagaagcctggcgccagtgttaaggtgtcctgtaaagcgtccggctactccttcacttcttattacatgcactgggtgcgccaggcccctggtcagggtctcgagtggatgggcataattaatccatctggcggtaccacaagctacgctcagaaatttcaggggcgggttacaatgactcgtgacacctctacctcgaccgtgtacatggagctgtcctcgttgaggagcgaagacactgcggtgtactactgtgcccgcgacaactcgccctatagcagcagctggtgggattacttcgactattggggccagggtactctggtgaccgtgagcagtggcggaggaggctcaggggggggagggagcgggggaggaggctccgacatccagatgacccagagcccttcttctctgtctgcctcagtgggcgatcgcgtcaccatcacctgccgggcttcccaggatatccgccactacctggcgtggtaccagcagaagcccggcaaggccccgaagctgctgatctatgacgcttcctcattgcagagcggcgtaccgtcccgcttctccggctcgggatctggcacggatttcaccctcactatctcctcacttcagccagaggatttcgccacctactattgccaacagacgtacgacgcccccatcaccttcggccagggtacacgcctggagattaag

SEQ ID NO: 222 - DNA, 1521 bp, Artificial Sequence
  NK77.77_64-64 scFv codon optimized
caggtgcagctggtgcagagcggagctgaggtgaagaagcccggttctagcgtgaaggtgagctgtaaagcctcgggttacacgttcacaagctatggcatcagttgggtgcgccaggcccccggtcagggcctggagtggatgggcggcatcattcccatcttcggtacgaccaactacgcgcagaagttccagggccgtgtgactatcactgcggacgagagcacctccactgcttacatggagctgtcgtccctgcgctccgaggacaccgccgtgtactactgcgctcgcgatcactccggtgacggctactttgatctttggggccgtggtactctggtgaccgtgtccagcggggggggcggatctggcggtggcggcagcggcggaggaggctccgacattgtcatgacccagtcccctctgtccctcccagttacccccggcgagccagccagcatctcttgccgatcttcccagagcctactccacagcaacggctacaactatttggattggtacctgcagaagccggggcagagccctcagctgttaatctacgacgcctcctccctgcagtcgggagtccccgaccgcttcagcggcagtggctccggcaccgactttaccctgaagatatcccgcgtggaggccgaggacgtgggcgtctactactgcatgcaaggcacccattggcccccaaccttcggccagggcactaaagtcgagatcaagggcggtggaggctcgggcggcggtggctccggcggtgggggttcgcaggtccagcttgtgcagtctggcgcggaggtgaagaagccaggcagcagtgttaaagtatcttgtaaggcatctggatacaccttcaccagctacggcattagttgggtccgccaggccccgggacagggactggagtggatgggcggcatcattcccatcttcggcacgaccaactacgctcagaaatttcaggggcgcgtaaccatcaccgccgacgagtccacttccactgcctacatggaactgtcctcgctgcggtctgaagacacggccgtgtactactgcgcgcgggaccactctggtgatggctatttcgacctttggggcagaggaacgcttgtcaccgtcagctcgggggggggtggttccggcggcgggggctccggcgggggtggcagtgacatcgtgatgacccagagtcctttgtctctgccggtaacaccgggggagcccgcttctatctcttgtcgttcttcacagagcctcctgcattcaaatggctataactacctggactggtacctccagaagcctgggcaatctcctcagctgctgatctatgacgcatcctccttgcagtctggcgttccggacaggttttcaggctccgggtcgggcaccgatttcaccctcaagatctctcgcgtggaggctgaagatgtgggggtgtattactgtatgcagggtacacactggcctcccaccttcggccagggcaccaaggtggagattaag

SEQ ID NO: 223 - DNA, 1485 bp, Artificial Sequence
  NK77.78_65-65 scFv codon optimized
caggtccagctggtgcagagcggggcggaggtgaagaagcccggtgcgtccgtaaaggtatcatgcaaagcctcgggctacacgttcacagagaatgagatgcattgggtccgtcaggcccccggccagggcctagagtggatgggctggattaaccctaactcgggaggcaccaactatgcccagaaatttcagggccgcgttacaatgacccgcgacacgtccacgagcaccgtctacatggagctgagttctttgcggtcggaggacaccgccgtgtactactgtgctggtagttggggcggatattacttcgactattggggccaaggcactttagtcaccgtctcctcgggtgggggcggctctggcggaggcggttctggcgggggtggaagcgatatccagatgacccagagccctagctcactctccgcctccgtgggtgatcgtgtgaccatcacctgtcgggcttcccagtccgtgtcccgctacctgaattggtaccaacagaagccgggcaaggcacctaagctgctcatctacgacgcctctaacctggagaccggtgtgccatcgcgtttctccggttccggctcgggtactgatttcaccctgaccatctcgtccctgcagccagaagattttgccacctattactgtcagcaggcggacagcttccccgtgaccttcggccaggggaccaagctggaaattaagggcggcggaggctccgggggcggcggctctggcggggggggctcccaggtgcagctagtgcagtctggcgccgaggtgaagaaacctggcgcttccgtcaaggtgtcatgcaaagcttcaggctacactttcaccgagaacgagatgcactgggtgcgccaggcgccgggccagggcctggagtggatggggtggattaatcccaacagcggtggtacgaactacgcccagaagttccagggacgcgtgactatgaccagagataccagcacatctaccgtgtacatggagctgagtagccttcgctcagaagacactgctgtttactactgcgccggctcttggggcggatactatttcgactactggggacaggggacccttgttaccgtgtcctctggaggcggcggctccggtggtggcggttccggaggcggtggttccgacatccagatgacccagagtccctctagcctgagcgcatccgtgggggacagggtcactatcacctgccgagcgtctcagagcgtgtcccgctacctcaactggtaccagcagaagcctgggaaggctcccaaactgctgatctatgacgcaagcaacctggagactggcgtcccctctcgcttttctgggagcggctcgggcaccgacttcaccctcactatctcctccttgcagccggaggactttgctacctactactgtcaacaggcggactccttcccggtgaccttcggacagggcaccaagttggagatcaag

SEQ ID NO: 224 - DNA, 1530 bp, Artificial Sequence
  NK77.79_38-67 scFv codon optimized
caggtgcagctggtgcagagcggagcagaggtgaagaagcctggcgctagtgttaaagtgtcctgtaaggcaagcggctactccttcaccagctactacatgcactgggtccgccaggccccggggcagggcctggagtggatgggcatcatcaatccatcaggggggacaacgagctatgcgcagaaatttcagggtcgcgtcactatgactcgcgacacatcaacctccaccgtgtacatggagctgagctctctgcgcagcgaggacaccgccgtctactactgtgctcgtgacaactccccctacagctcttcttggtgggactatttcgattattggggccagggaaccttggtaactgtgagttctggcggcggaggatcgggaggaggtggctcgggcgggggtggtagcgacatccagatgacccagagcccctctagtctttccgcgtctgtgggagaccgggttaccatcacctgccgagcctcccaggatatccgccactacctggcgtggtaccagcagaagccgggtaaggcccccaagctgctgatttacgacgcttcgagtctgcaatctggtgtcccctcccgcttcagcggctcaggctccggcactgatttcaccctgaccatttctagccttcagccggaggactttgctacctactactgtcaacagacctacgacgcacctatcactttcggtcagggcacccgcctggagatcaagggcggcggcggctccggcggcggcggtagcggtggcgggggtagccaggtccaactggtgcagtctggagcggaggtgaaaaaacctggctccagcgtaaaggtgtcgtgcaaggcctccggcggtaccttctctagctatgccatcagttgggtgcgccaggcgccaggccagggtttggagtggatgggtggcatcacgccgatgtttggcacgacggactacgctcagaagttccagggtcgtgtcactattacagccgacgaatcgacctctaccgcctacatggagctctcctctttgaggtccgaggataccgctgtttattactgcgctcgggacgagcgcgacggctatgccacggtggccttcgacatatggggccaggggacgatggtgacagtgtcctccggtggcggggggagcggtggcggcggctccggaggcggcggttccgacattgtgatgacccagtctcccctgtcccttccggtgactcccggtgagccagcttcaatctcctgtcgctcctcccagtctctactccattcaaacggctacaactacctcgattggtacctgcagaagcccgggcagtcgcctcagctactcatctacgatgccagcaacctggaaaccggcgtccccgacaggttttcgggctccgggtcgggcaccgacttcactctgaagatctctcgtgtggaggccgaagatgtgggcgtctactactgcatgcagggcacccactggccccctaccttcggccagggcaccaaggtggagatcaag

SEQ ID NO: 225 - DNA, 1515 bp, Artificial Sequence
  NK77.80_38-68 scFv codon optimized
caggtccagctggtgcagtctggcgccgaggtgaagaagcctggggccagtgttaaggtctcatgtaaagcatccggctactcctttaccagctactatatgcattgggtccggcaggccccggggcaggggctagagtggatgggcatcataaacccatcaggtggcaccacgagctacgcacagaagttccagggtagagttaccatgactcgcgacacctctacctccaccgtgtacatggagctctcctccctccgctcggaggacacggccgtatactactgtgcccgtgacaactccccctattcctcgagctggtgggattatttcgactattggggccagggcactctggtgacagtgtccagtgggggaggagggtctggcggtggcggctcgggcggcggcggtagcgacatccagatgacccagagcccgagctctctgtccgcctccgtgggcgatcgggtcaccatcacctgccgagcgtcccaggacatccgccactacttggcttggtatcagcagaagcctggtaaggcccccaaattattgatctacgacgcttcgtccctccagtcgggcgtgccttcccgtttcagtggctcgggatcaggcaccgatttcacccttacaatctcgtctctgcagccggaggactttgccacctactactgccaacagacgtacgatgcacccatcaccttcggccagggaacccgcctggagattaagggtggtggaggttctggcggcgggggctccggcggaggtggttcacaggtgcagctggtgcaaagtggagcggaagtgaagaagccgggcgcgagcgtcaaggtgtcatgcaaagcctctggctacactttcacgagttactacatgcactgggtgcgccaggccccgggacagggcctggagtggatgggcattatcaatccatccgatggcggcacatcgtacgcggacaaatttcagggccgcgtgaccatgaccagggacaccagtacttctaccgtgtacatggagctgtcctccctgcgcagcgaagacacggcggtgtactactgtgctcgcgccctggcgcctttgggctggggcgatggaatggacgtgtggggtcagggtactaccgtcaccgtgtcctctggaggcgggggctctgggggcggtggctccggcgggggtgggagtgacatccagatgacccagtccccaagctctctttccgcctccgtgggggacagggtcaccattacctgtcaggctagccaggatatctcgaactacctcaactggtaccagcagaagcccggcaaggctcccaagctgctgatttacgacgccagcaacctggagaccggcgttccctcccgcttctctggtagcggctccggcacggacttcaccctgaccatctcttcgctacagcctgaggactttgctacgtactactgccaacagagctatgacggccccatcaccttcggccagggcacccgtctggagatcaag

SEQ ID NO: 226 - DNA, 1530 bp, Artificial Sequence
  NK77.81_64-67 scFv codon optimized
caggtgcagctggtgcagagcggagcagaggtgaagaagcccggctcgtccgtgaaggtgtcctgtaaagcttctggatacaccttcaccagctacggcattagttgggttcgccaggccccggggcagggtctggagtggatgggaggcattatccccatcttcggaacgaccaactatgcccagaaatttcagggcagagtcaccatcactgcggacgagagcacctccaccgcctacatggagctgtcttctctgcgctctgaagataccgccgtgtactactgtgcccgcgaccactctggtgatggctatttcgacctttggggtcgcggcactctggtgaccgtgtcctctgggggcgggggttccggcggaggcggctccggtggcggaggctctgacatcgtgatgacccagagcccactgtcgctgcccgtcacaccgggggagcctgcttccatctcatgccgatcctcccagagtctcttacactctaatggctacaactacctggactggtacctgcagaagcctggccagagcccacagctgcttatctacgacgcctcgtctttgcagagtggcgtgcccgaccgcttctctggcagtggttcaggcaccgatttcaccctgaagatctcgcgcgtggaggctgaggatgtgggcgtctactactgcatgcaggggactcactggcctcccacttttgggcagggaacaaaagtggagatcaagggcggaggcggcagcggcggcggaggaagcggaggcggagggtcacaggtccagttggtgcagagtggcgcggaagtcaagaaacctggctccagcgtcaaggtttcctgtaaggctagcgggggcacgttcagtagctacgctatctcctgggtgcgccaggcccccggtcagggtctcgaatggatgggcggcatcactccaatgtttggcaccacagattacgcgcagaagttccagggaagggtgactatcaccgccgacgagagcaccagcactgcgtacatggagctgagctccctgcgctcggaggacaccgctgtctattattgtgctcgtgacgagcgggacggctacgccactgtagccttcgacatctggggccagggcactatggtaaccgtatcgtcgggagggggaggctccggtggcgggggttccggtgggggtgggtccgacattgtgatgacccagtcccccctcagcctgccggtaacaccgggtgagccagcatctatctcctgccggtcctcccaatctctcctgcactccaacggctacaactacttggattggtacctacagaagccggggcagtcacctcagctgcttatctacgacgcaagcaacctggagaccggcgttcccgacaggttctctggctcgggctctggcacggactttacgctaaagatatcccgtgtcgaggccgaggacgtgggggtgtactattgcatgcaaggtacgcattggccccctaccttcggtcaaggcaccaaggtggagattaag

SEQ ID NO: 227 - DNA, 1515 bp, Artificial Sequence
  NK77.82_64-68 scFv codon optimized
caggtgcagctcgtgcagtcgggggccgaggttaaaaagcctggttccagcgtcaaagtctcctgtaaggcctctggctacaccttcaccagctacggcatcagttgggtccgccaggccccgggccagggccttgagtggatggggggcatcatccccatcttcgggacgaccaactacgcgcagaagttccagggaagagttacgatcacggcggacgagagcacctccaccgcttacatggagctgtcctccctccgtagcgaggatacagccgtgtactactgcgcccgggaccactccggtgatggctatttcgacctttggggccgtggcactttggtgactgtgagttctggcggcggcggtagcggagggggtggctcaggaggtggtggaagtgacatcgtgatgacccagagccctttatccctgccggtgactccgggcgagccagcttctatctcctgccgaagctcacagtcgctgctccattccaatggttacaactacttggattggtacctgcagaagcccggccagagccctcagctgctcatctatgacgcctcgtcccttcaatcaggcgtccccgacaggttttctggctctggatctggcaccgactttaccctgaagatatcccgcgtggaggctgaagatgtgggcgtgtactactgtatgcagggcacacactggcccccaacctttggccagggcaccaaggtggagatcaaaggcggcgggggttctgggggtggcggctccggtggaggcggctcccaggtccagctggtgcagtcgggggcagaggtgaagaagccgggcgcgtccgtgaaggtatcatgtaaggcttccggatacaccttcaccagctattacatgcactgggtgcgccaggctcccgggcaagggctggagtggatgggcattattaacccctctgacggcggcactagctacgcggacaaatttcagggacgggtaacaatgactcgcgacacgtccactagcaccgtctacatggaactgtcgtccctacgctcggaggacaccgcagtgtattactgtgcccgtgcgctggcgcccctgggctggggcgatggaatggatgtatggggccaaggcacgaccgtcaccgtgagctctgggggtggaggttcgggtggtgggggttctggtggtggcgggtccgacatccagatgacccagagcccaagctccctgtccgcctctgtcggggaccgcgtgaccatcacctgccaggcctcccaggacatctccaactatcttaactggtaccagcagaagcctggcaaggctcctaagctgctgatttacgacgcaagcaacctggagactggagtgccctctcgcttctcgggaagtggctctggaactgatttcactctgaccatcagctccttgcagccagaggacttcgccacctactattgccagcagtcttacgacggccccatcaccttcggccaggggacccgcctggagattaag

SEQ ID NO: 228 - DNA, 1512 bp, Artificial Sequence
  NK77.83_65-67 scFv codon optimized
caggtgcagctggtgcagagcggcgctgaggtgaagaaacctggcgcgtccgtcaaggtgtcctgtaaggcctctggctacaccttcaccgagaacgagatgcactgggtgcgccaggcccctggtcagggcctcgagtggatggggtggattaatcccaactccggcggcaccaactacgcgcagaagttccagggccgcgtgactatgacccgcgacacttccacctccaccgtgtacatggagctgtcctccctacgttccgaggacacggccgtgtactactgcgctggcagttggggcggctattacttcgattattggggccaggggactctggtgactgtctcttccggagggggaggatcgggcggcgggggttcaggtggcggcggaagcgatatccagatgactcagtcaccttctagcctgtctgctagcgtaggcgacagggtgaccatcacctgccgagcttctcagtccgtgagccgctacctcaactggtaccagcagaagccaggcaaagcccccaagctgctcatctacgacgcgtctaatctggagacgggtgtcccgtcccgcttttcaggctcgggttctgggacagatttcaccctgaccatctcttctcttcagccggaggacttcgcaacctactactgccaacaggcggattccttccccgtgaccttcggacagggcaccaagctcgagattaagggcggcggcggctcgggtggtgggggctccggagggggaggttcccaggtccagttggtgcagtcgggcgccgaagttaagaagcccgggtcgtccgtcaaggtgtcatgcaaggcatccggtggcactttttctagctacgccatcagttgggtgcgtcaggctcctgggcagggtctggagtggatgggcggcatcacccccatgtttggcacaaccgactacgctcagaagttccagggcagagtcaccatcacagcggacgagagcaccagcaccgcctacatggagctgtcgtcactgcgtagcgaagacaccgcagtgtattactgtgcccgggacgagcgcgacggctatgccacggtggccttcgacatctggggccagggtactatggtgaccgtatcttccggtgggggcggctccggcggtggtggcagtgggggaggaggctccgacatcgtgatgacccagtccccgctttcgctgcccgttacgcccggcgagccagcttctatctcgtgtcggtcttcccagagcttacttcatagcaacggctataactacttggattggtacctgcagaagccgggtcaatctcctcagctgctgatttatgacgccagcaacctggaaaccggtgtgcccgaccgcttcagcggctccggcagcggtaccgactttacgctgaagataagtcgcgtcgaggccgaggatgtaggcgtctactactgtatgcagggaacgcactggcccccaaccttcggccaagggaccaaagtggagatcaaa

SEQ ID NO: 229 - DNA, 1497 bp, Artificial Sequence
  NK77.84_65-68 scFv codon optimized
caggtccagctggtgcagtccggtgctgaggtgaagaagcctggggcatcggtgaaggtgtcatgcaaggcctcgggctacaccttcaccgagaacgagatgcactgggtgcgccaggcgcccggacagggcctggaatggatggggtggattaatccaaactccggcggcaccaactatgcgcagaaatttcagggacgggtcactatgactcgcgacacctccacctccacagtctacatggagctctcaagtttacggtccgaggacacggccgtgtactactgtgctggaagttggggcggctattatttcgactattggggccaaggcaccttggttaccgtgtcctccgggggcggaggttctggcggcggcggcagcggtggcggggggagcgatatccagatgacccagtcaccaagctcgctgtccgcctccgtgggggacagagtcacaattacctgccgagcatcacaatccgtatctcgctacctgaattggtaccagcagaagccgggcaaggcccctaagctgctgatttacgacgcctccaacctagagactggcgtcccctctaggttttcagggtctggaagcggcactgatttcaccctgaccatctcctctctgcagccggaggactttgccacctactactgccagcaggcggactccttcccggtgaccttcggtcagggcaccaagctcgagatcaaaggcggtggcggatcgggcggtggtgggtctggaggtggaggttctcaggtgcagttggtgcagagcggcgctgaggtgaagaagcccggtgcctccgttaaggtgtcatgcaaagcttctggttacacgttcaccagctattacatgcattgggtccgtcaggccccgggacagggccttgagtggatgggcatcatcaaccccagtgacggcggcacgtcttacgcggacaagttccagggccgtgtaactatgacgcgcgacacctctacgtcgaccgtctacatggagctctcttctctgcgcagcgaagacaccgccgtgtactactgtgctcgcgcgctggcccccctgggctggggcgacggtatggacgtgtggggccagggcacgacagtgaccgtgagttccgggggcggcgggtccggtgggggcggttccggcggcggtggttccgacatccagatgacccagagcccttcttctctttccgcgtctgtgggtgatcgtgttactatcacctgtcaggcttcccaggacatcagcaactacctcaactggtaccaacagaagcccggcaaagcccccaagctgctcatctacgacgcttccaacctggagaccggcgtcccttcccgcttcagcggctcgggctccgggaccgacttcactctgaccatctctagcttgcagccagaggattttgccacttactactgtcagcagagctacgatgggcccatcacattcggacagggcacccgcctggagataaag

SEQ ID NO: 230 - protein, 240 aa, Artificial Sequence
  NK77.1_CD70_DB01_C03 scFv
QVQLVQSGAEVKKPGASVKVSCKASGYTFTGHYLHWVRQAPGQGLEWMGWINPNSGGTNYAQKFQGRVTMTRDTSTSTVYMELSSLRSEDTAVYYCVRGSGWYDLDYWGQGTLVTVSSGGGGSGGGGSGGGGSDIQMTQSPSSLSASVGDRVTITCRASQNIGTYLAWYQQKPGKAPKLLIYDASNLETGVPSRFSGSGSGTDFTLTISSLQPEDFATYYCQQSYRIPLTFGQGTRLEIK

SEQ ID NO: 231 - protein, 241 aa, Artificial Sequence
  NK77.2_CD70_DB01_D02 scFv
QVQLVQSGAEVKKPGASVKVSCKASGYTFTNYYMHWVRQAPGQGLEWMGIINPSGGSTSYAQKFQGRVTMTRDTSTSTVYMELSSLRSEDTAVYYCARELGVAGYFDLWGRGTLVTVSSGGGGSGGGGSGGGGSDIQMTQSPSSLSASVGDRVTITCRASQRISNWLAWYQQKPGKAPKLLIYDASNLETGVPSRFSGSGSGTDFTLTISSLQPEDFATYYCQQTYSPPPTFGQGTKLEIK

SEQ ID NO: 232 - protein, 250 aa, Artificial Sequence
  NK77.3_CD70_DB01_E06 scFv
QVQLVQSGAEVKKPGASVKVSCKASGYTFTGYYIHWVRQAPGQGLEWMGIINPSGGSTSYAQKFQGRVTMTRDTSTSTVYMELSSLRSEDTAVYYCARDLSGIDGYIGFFDYWGQGTLVTVSSGGGGSGGGGSGGGGSDIVMTQSPLSLPVTPGEPASISCRSSQSLLHSNGYNYLDWYLQKPGQSPQLLIYAASSLQSGVPDRFSGSGSGTDFTLKISRVEAEDVGVYYCMQALQTPITFGQGTRLEIK

SEQ ID NO: 233 - protein, 241 aa, Artificial Sequence
  NK77.4_CD70_DB01_G04 scFv
QVQLVQSGAEVKKPGASVKVSCKASGGTFRSHVISWVRQAPGQGLEWMGIIDPSGGSTSYAQRFQGRVTMTRDTSTSTVYMELSSLRSEDTAVYYCAKDYTGLLGMDVWGQGTTVTVSSGGGGSGGGGSGGGGSDIQMTQSPSSLSASVGDRVTITCRASQDIDTYLAWYQQKPGKAPKLLIYAASSLQSGVPSRFSGSGSGTDFTLTISSLQPEDFATYYCQQSYTTPFTFGQGTKVEIK

SEQ ID NO: 234 - protein, 241 aa, Artificial Sequence
  NK77.5_CD70_DB01_G05 scFv
QVQLVQSGAEVKKPGASVKVSCKASGYTFIDYYIHWVRQAPGQGLEWMGWMNPNSGNTGYAQKFQGRVTMTRDTSTSTVYMELSSLRSEDTAVYYCARGLSGYDLDDYWGQGTLVTVSSGGGGSGGGGSGGGGSDIQMTQSPSSLSASVGDRVTITCQASQDISNYLNWYQQKPGKAPKLLIYDASSLESGVPSRFSGSGSGTDFTLTISSLQPEDFATYYCQQSYRSPLTFGGGTKVEIK

SEQ ID NO: 235 - protein, 240 aa, Artificial Sequence
  NK77.6_CD70_DB01_G07 scFv
QVQLVQSGAEVKKPGASVKVSCKASGYTFTSYYMHWVRQAPGQGLEWMGWINPNSGGTKYAHKFQGRVTMTRDTSTSTVYMELSSLRSEDTAVYYCARGLSGYDFDYWGQGTTVTVSSGGGGSGGGGSGGGGSDIQMTQSPSSLSASVGDRVTITCQASQDISNYLNWYQQKPGKAPKLLIYDASNLETGVPSRFSGSGSGTDFTLTISSLQPEDFATYYCQQAYRWPITFGQGTRLEIK

SEQ ID NO: 236 - protein, 241 aa, Artificial Sequence
  NK77.7_CD70_DB01_G11 scFv
QVQLVQSGAEVKKPGASVKVSCKASGYTFTGYYMHWVRQAPGQGLEWMGWMNPNSGNTGYAQKFQGRVTMTRDTSTSTVYMELSSLRSEDTAVYYCARGTDVYGDFDYWGQGTLVTVSSGGGGSGGGGSGGGGSDIQMTQSPSSLSASVGDRVTITCRASQSISSYLNWYQQKPGKAPKLLIYDASYLETGVPSRFSGSGSGTDFTLTISSLQPEDFATYYCQQSYTIPPTFGQGTKVEIK

SEQ ID NO: 237 - protein, 248 aa, Artificial Sequence
  NK77.9_CD70_DB02_A03 scFv
QVQLVQSGAEVKKPGSSVKVSCKASGYTFTENEMHWVRQAPGQGLEWMGGIIPIFGTANYAQKFQGRVTITADESTSTAYMELSSLRSEDTAVYYCAREGGTAMATGYYYYGMDVWGQGTTVTVSSGGGGSGGGGSGGGGSDIQMTQSPSSLSASVGDRVTITCQASQDISNYLNWYQQKPGKAPKLLIYDASNLETGVPSRFSGSGSGTDFTLTISSLQPEDFATYYCQQSYSTPLTFGQGTKVEIK

SEQ ID NO: 238 - protein, 246 aa, Artificial Sequence
  NK77.10_CD70_DB02_A04 scFv
QVQLVQSGAEVKKPGASVKVSCKASGYTFTENEMHWVRQAPGQGLEWMGWINSNGGYTGYALKFQGRVTMTRDTSTSTVYMELSSLRSEDTAVYYCARASNYGGHFDYWGQGTLVTVSSGGGGSGGGGSGGGGSDIVMTQSPLSLPVTPGEPASISCRSSQSLLHSNGYNYLDWYLQKPGQSPQLLIYQASSLESGVPDRFSGSGSGTDFTLKISRVEAEDVGVYYCMQGTHWPPTFGGGTKVEIK

SEQ ID NO: 239 - protein, 241 aa, Artificial Sequence
  NK77.11_CD70_DB02_A05 scFv
QVQLVQSGAEVKKPGASVKVSCKASGYTFTSYYMHWVRQAPGQGLEWMGIINPSGGSTIYAQKFQGRVTMTRDTSTSTVYMELSSLRSEDTAVYYCAKDMGAWAAGFDYWGQGTLVTVSSGGGGSGGGGSGGGGSDIQMTQSPSSLSASVGDRVTITCQASQDISNYLNWYQQKPGKAPKLLIYATSTLANGVPSRFSGSGSGTDFTLTISSLQPEDFATYYCQQSYSTLTFGQGTRLEIK

SEQ ID NO: 240 - protein, 242 aa, Artificial Sequence
  NK77.12_CD70_DB02_A06 scFv
QVQLVQSGAEVKKPGASVKVSCKASGYTFTGYYMHWVRQAPGQGLEWMGWINPNSGDTGYAQKFQGRVTMTRDTSTSTVYMELSSLRSEDTAVYYCARSVNDYGDYDGYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTLTISSLQPEDFATYYCQQSYSTPPTFGQGTKVEIK

SEQ ID NO: 241 - protein, 242 aa, Artificial Sequence
  NK77.13_CD70_DB02_A07 scFv
QVQLVQSGAEVKKPGASVKVSCKASGYTFTGYYMHWVRQAPGQGLEWMGIINPSGGSTSYAQKFQGRVTMTRDTSTSTVYMELSSLRSEDTAVYYCARDYGDYDASFDYWGQGTLVTVSSGGGGSGGGGSGGGGSDIQMTQSPSSLSASVGDRVTITCRASQSIDNWLAWYQQKPGKAPKLLIYAASTLQSGVPSRFSGSGSGTDFTLTISSLQPEDFATYYCQQSYDSPPTFGQGTKLEIK

SEQ ID NO: 242 - protein, 239 aa, Artificial Sequence
  NK77.14_CD70_DB02_A08 scFv
QVQLVQSGAEVKKPGASVKVSCKASGYTFTSYDINWVRQAPGQGLEWMGIINPSDGSTIYAQNFQGRVTMTRDTSTSTVYMELSSLRSEDTAVYYCVKEEAWYFDLWGRGTLVTVSSGGGGSGGGGSGGGGSDIQMTQSPSSLSASVGDRVTITCQASQDISNYLNWYQQKPGKAPKLLIYDASNLETGVPSRFSGSGSGTDFTLTISSLQPEDFATYYCQQSYSTPLTFGGGTKVEIK

SEQ ID NO: 243 - protein, 239 aa, Artificial Sequence
  NK77.15_CD70_DB02_A09 scFv
QVQLVQSGAEVKKPGASVKVSCKASGYTFTSYYMHWVRQAPGQGLEWMGWMNPDNGDTGYAQMFQGRVTMTRDTSTSTVYMELSSLRSEDTAVYYCASGDYYDILYWGQGTLVTVSSGGGGSGGGGSGGGGSDIQMTQSPSSLSASVGDRVTITCQASQDISNYLNWYQQKPGKAPKLLIYDVSNLETGVPSRFSGSGSGTDFTLTISSLQPEDFATYYCQQANSFPLTFGGGTKVEIK

SEQ ID NO: 244 - protein, 240 aa, Artificial Sequence
  NK77.16_CD70_DB02_A11 scFv
QVQLVQSGAEVKKPGASVKVSCKASGYTFTSYYMHWVRQAPGQGLEWMGWMNPNSGDTGYAQKFQGRVTMTRDTSTSTVYMELSSLRSEDTAVYYCARGPSGYEFDYWGQGTLVTVSSGGGGSGGGGSGGGGSDIQMTQSPSSLSASVGDRVTITCRASQTISNYLNWYQQKPGKAPKLLIYDASSLESGVPSRFSGSGSGTDFTLTISSLQPEDFATYYCQQAISFPLTFGGGTKVEIK

SEQ ID NO: 245 - protein, 244 aa, Artificial Sequence
  NK77.17_CD70_DB02_B06 scFv
QVQLVQSGAEVKKPGASVKVSCKASGYTFTDYYMHWVRQAPGQGLEWMGIINPNSGGTNYAQKFQGRVTMTRDTSTSTVYMELSSLRSEDTAVYYCARDFSVYAAADGMDVWGQGTLVTVSSGGGGSGGGGSGGGGSDIQMTQSPSSLSASVGDRVTITCRASQSISSYLNWYQQKPGKAPKLLIYDASNLATGVPSRFSGSGSGTDFTLTISSLQPEDFATYYCQQSDSSPLTFGQGTKVEIK

SEQ ID NO: 246 - protein, 243 aa, Artificial Sequence
  NK77.18_CD70_DB02_B09 scFv
QVQLVQSGAEVKKPGASVKVSCKASGYTFTGYYMHWVRQAPGQGLEWMGIINPGDGGTIYAQNFQGRVTMTRDTSTSTVYMELSSLRSEDTAVYYCARGFGESAPDAFDIWGQGTMVTVSSGGGGSGGGGSGGGGSDIQMTQSPSSLSASVGDRVTITCQASQDISNYLNWYQQKPGKAPKLLIYGATTLQSGVPSRFSGSGSGTDFTLTISSLQPEDFATYYCQQADSFPYTFGQGTKLEIK

SEQ ID NO: 247 - protein, 240 aa, Artificial Sequence
  NK77.19_CD70_DB02_C03 scFv
QVQLVQSGAEVKKPGASVKVSCKASGYTFTGYYMHWVRQAPGQGLEWMGIINPSGGSTSYAQKFQGRVTMTRDTSTSTVYMELSSLRSEDTAVYYCAAGTEIYYMDVWGKGTTVTVSSGGGGSGGGGSGGGGSDIQMTQSPSSLSASVGDRVTITCRASQTIDIYLNWYQQKPGKAPKLLIYDASNLETGVPSRFSGSGSGTDFTLTISSLQPEDFATYYCQQADSFPLTFGGGTKVEIK

SEQ ID NO: 248 - protein, 249 aa, Artificial Sequence
  NK77.20_CD70_DB02_C04 scFv
QVQLVQSGAEVKKPGASVKVSCKASGGTFSSYAISWVRQAPGQGLEWMGMINPSDGATTYAQKFQGRVTMTRDTSTSTVYMELSSLRSEDTAVYYCARERELLHFATNYYYYGMDVWGQGTTVTVSSGGGGSGGGGSGGGGSDIQMTQSPSSLSASVGDRVTITCRASQGISNNLNWYQQKPGKAPKLLIYAASSLHSGVPSRFSGSGSGTDFTLTISSLQPEDFATYYCQQADAFPLTFGGGTKVEIK

SEQ ID NO: 249 - protein, 245 aa, Artificial Sequence
  NK77.22_CD70_DB02_C07 scFv
QVQLVQSGAEVKKPGASVKVSCKASGYTFTRNYMHWVRQAPGQGLEWMGWISPDNGVTNYAQNFQGRVTMTRDTSTSTVYMELSSLRSEDTAVYYCAKTQGSSSWYQWYFDLWGRGTLVTVSSGGGGSGGGGSGGGGSDIQMTQSPSSLSASVGDRVTITCRASQSIGTWLAWYQQKPGKAPKLLIYAASSLQSGVPSRFSGSGSGTDFTLTISSLQPEDFATYYCQQSYTTPITFGQGTKVEIK

SEQ ID NO: 250 - protein, 241 aa, Artificial Sequence
  NK77.24_CD70_DB02_D02 scFv
QVQLVQSGAEVKKPGASVKVSCKASGYTFTSYYMHWVRQAPGQGLEWMGIIDPGSGDTSYAQKFQGRVTMTRDTSTSTVYMELSSLRSEDTAVYYCARGSNWYDYFDYWGQGTLVTVSSGGGGSGGGGSGGGGSEIVMTQSPATLSVSPGERATLSCRASQSVSSYLAWYQQKPGQAPRLLIYGASTRATGIPARFSGSGSGTEFTLTISSLQSEDFAVYYCQQYDSYPPTFGGGTKVEIK

SEQ ID NO: 251 - protein, 241 aa, Artificial Sequence
  NK77.25_CD70_DB02_D04 scFv
QVQLVQSGAEVKKPGASVKVSCKASGYRLSDHYMHWVRQAPGQGLEWMGIINPSGGSTTYAQNFQGRVTMTRDTSTSTVYMELSSLRSEDTAVYYCASSYYGDYVLVNWGQGTLVTVSSGGGGSGGGGSGGGGSDIQMTQSPSSLSASVGDRVTITCQASQDISNYLNWYQQKPGKAPKLLIYAASTLESGVPSRFSGSGSGTDFTLTISSLQPEDFATYYCLQDYDYPLTFGQGTKLEIK

SEQ ID NO: 252 - protein, 242 aa, Artificial Sequence
  NK77.26_CD70_DB02_D10 scFv
QVQLVQSGAEVKKPGASVKVSCKASGYTFTDYYVHWVRQAPGQGLEWMGWINPNTGGTSFAQNFQGRVTMTRDTSTSTVYMELSSLRSEDTAVYYCARDLGQWLGEIDYWGQGTLVTVSSGGGGSGGGGSGGGGSDIQMTQSPSSLSASVGDRVTITCRASQTIYKWLAWYQQKPGKAPKLLIYDASSLESGVPSRFSGSGSGTDFTLTISSLQPEDFATYYCQQANSFPFTFGPGTKVDIK

SEQ ID NO: 253 - protein, 246 aa, Artificial Sequence
  NK77.27_CD70_DB02_D11 scFv
QVQLVQSGAEVKKPGASVKVSCKASGYTFTDYTDYFVHWVRQAPGQGLEWMGIFNPSDGSTSYAQEFQGRVTMTRDTSTSTVYMELSSLRSEDTAVYYCARGPYSSSWYYFDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTLTISSLQPEDFATYYCQQAHSFPPTFGQGTKVEIK

SEQ ID NO: 254 - protein, 242 aa, Artificial Sequence
  NK77.28_CD70_DB02_E04 scFv
QVQLVQSGAEVKKPGASVKVSCKASGYIFTDYYMHWVRQAPGQGLEWMGIINPSGGDTLYAQKFQGRVTMTRDTSTSTVYMELSSLRSEDTAVYYCAREGVGAMGVFDYWGQGTLVTVSSGGGGSGGGGSGGGGSDIQMTQSPSSLSASVGDRVTITCRASTSISDYVHWYQQKPGKAPKLLIYDASSLQSGVPSRFSGSGSGTDFTLTISSLQPEDFATYYCQQSDSTPPTFGGGTKVEIK

SEQ ID NO: 255 - protein, 244 aa, Artificial Sequence
  NK77.29_CD70_DB02_F06 scFv
QVQLVQSGAEVKKPGASVKVSCKASGYTFTDHYIHWVRQAPGQGLEWMGWISAYNGKTNYAQKFQGRVTMTRDTSTSTVYMELSSLRSEDTAVYYCARDTIYYDFWSGYDYWGQGTLVTVSSGGGGSGGGGSGGGGSDIQMTQSPSSLSASVGDRVTITCRASQGISNNLNWYQQKPGKAPKLLIYYASTLQSGVPSRFSGSGSGTDFTLTISSLQPEDFATYYCQQSYSTPITFGQGTRLEIK

SEQ ID NO: 256 - protein, 244 aa, Artificial Sequence
  NK77.31_CD70_DB02_F08 scFv
QVQLVQSGAEVKKPGASVKVSCKASGYTFTSYYMHWVRQAPGQGLEWMGIINPSGGATIYAQKFQGRVTMTRDTSTSTVYMELSSLRSEDTAVYYCARSRGDYYGSGDFDYWGQGTLVTVSSGGGGSGGGGSGGGGSDIQMTQSPSSLSASVGDRVTITCRASQTISNYLNWYQQKPGKAPKLLIYDASTLEAGVPSRFSGSGSGTDFTLTISSLQPEDFATYYCQQSYNPPYTFGQGTKLEIK

SEQ ID NO: 257 - protein, 240 aa, Artificial Sequence
  NK77.32_CD70_DB02_G07 scFv
QVQLVQSGAEVKKPGASVKVSCKASGYTFTDYYMHWVRQAPGQGLEWMGIINPSGGSTSYAQKFQGRVTMTRDTSTSTVYMELSSLRSEDTAVYYCARGYFDHAFDIWGQGTMVTVSSGGGGSGGGGSGGGGSDIQMTQSPSSLSASVGDRVTITCRASQSISTYLNWYQQKPGKAPKLLIYDASNLEIGVPSRFSGSGSGTDFTLTISSLQPEDFATYYCQQSDSSPLTFGQGTKVEIK

SEQ ID NO: 258 - protein, 246 aa, Artificial Sequence
  NK77.33_CD70_DB02_H04 scFv
QVQLVQSGAEVKKPGASVKVSCKASGYTFTGYYMHWVRQAPGQGLEWMGIINPSGGDTIYAQKFQGRVTMTRDTSTSTVYMELSSLRSEDTAVYYCARGDSSSWYDYYYYMDVWGKGTTVTVSSGGGGSGGGGSGGGGSDIQMTQSPSSLSASVGDRVTITCQASQDISNYLNWYQQKPGKAPKLLIYAASSLQSGVPSRFSGSGSGTDFTLTISSLQPEDFATYYCQQSYRTPLTFGGGTKVEIK

SEQ ID NO: 259 - protein, 241 aa, Artificial Sequence
  NK77.34_CD70_DB02_H05 scFv
QVQLVQSGAEVKKPGASVKVSCKASGYTFTDYFTHWVRQAPGQGLEWMGWINTYDGNTNYAQKFQGRVTMTRDTSTSTVYMELSSLRSEDTAVYYCAREMEWLGQVDYWGQGTLVTVSSGGGGSGGGGSGGGGSDIQMTQSPSSLSASVGDRVTITCRASQDIRNDLGWYQQKPGKAPKLLIYAASNLETGVPSRFSGSGSGTDFTLTISSLQPEDFATYYCQQSYSAPFTFGPGTKVDIK

SEQ ID NO: 260 - protein, 241 aa, Artificial Sequence
  NK77.35_CD70_DB02_H08 scFv
QVQLVQSGAEVKKPGASVKVSCKASGYTFTSYYIHWVRQAPGQGLEWMGRINPNGGGTNYAQKFQGRVTMTRDTSTSTVYMELSSLRSEDTAVYYCARGHRGGGGIDYWGQGTLVTVSSGGGGSGGGGSGGGGSDIQMTQSPSSLSASVGDRVTITCRASQEISNYLAWYQQKPGKAPKLLIYDASNLQTGVPSRFSGSGSGTDFTLTISSLQPEDFATYYCQQSYSTPFTFGPGTKVDIK

SEQ ID NO: 261 - protein, 241 aa, Artificial Sequence
  NK77.36_CD70_DB03_A06 scFv
QVQLVQSGAEVKKPGASVKVSCKASGGTFSSYAISWVRQAPGQGLEWMGWISPNSGDTHYAQKFQGRVTMTRDTSTSTVYMELSSLRSEDTAVYYCARDWGSGWYVDYWGQGTLVTVSSGGGGSGGGGSGGGGSDIQMTQSPSSLSASVGDRVTITCQASQDISDSLNWYQQKPGKAPKLLIYSASSLQSGVPSRFSGSGSGTDFTLTISSLQPEDFATYYCQQSFTTPYTFGQGTKVEIK

SEQ ID NO: 262 - protein, 241 aa, Artificial Sequence
  NK77.37_CD70_DB03_A07 scFv
QVQLVQSGAEVKKPGSSVKVSCKASGGTFNSYGISWVRQAPGQGLEWMGGIIPIFGTANYAQKFQGRVTITADESTSTAYMELSSLRSEDTAVYYCARDTYGDDAFDIWGQGTMVTVSSGGGGSGGGGSGGGGSDIQMTQSPSSLSASVGDRVTITCRASQSISSWLAWYQQKPGKAPKLLIYDASNLETGVPSRFSGSGSGTDFTLTISSLQPEDFATYYCQQNFSPPLTFGQGTRLEIK

SEQ ID NO: 263 - protein, 246 aa, Artificial Sequence
  NK77.38_CD70_DB03_A08 scFv
QVQLVQSGAEVKKPGASVKVSCKASGYSFTSYYMHWVRQAPGQGLEWMGIINPSGGTTSYAQKFQGRVTMTRDTSTSTVYMELSSLRSEDTAVYYCARDNSPYSSSWWDYFDYWGQGTLVTVSSGGGGSGGGGSGGGGSDIQMTQSPSSLSASVGDRVTITCRASQDIRHYLAWYQQKPGKAPKLLIYDASSLQSGVPSRFSGSGSGTDFTLTISSLQPEDFATYYCQQTYDAPITFGQGTRLEIK

SEQ ID NO: 264 - protein, 244 aa, Artificial Sequence
  NK77.39_CD70_DB03_A09 scFv
QVQLVQSGAEVKKPGASVKVSCKASGYTFTDYYIHWVRQAPGQGLEWMGWITPNSGYTYYAQNFQGRVTMTRDTSTSTVYMELSSLRSEDTAVYYCARNTDCYGDFLGLDVWGQGTTVTVSSGGGGSGGGGSGGGGSDIVMTQSPDSLAVSLGERATINCRASSSISNYLAWYQQKPGQPPKLLIYGASTRASGVPDRFSGSGSGTDFTLTISSLQAEDVAVYYCQQSYSTPLTFGQGTKVEIK

SEQ ID NO: 265 - protein, 244 aa, Artificial Sequence
  NK77.40_CD70_DB03_A11 scFv
QVQLVQSGAEVKKPGASVKVSCKASGYTFNGYLMHWVRQAPGQGLEWMGIVNPSDGSTGYAQKFQGRVTMTRDTSTSTVYMELSSLRSEDTAVYYCAKDTGLRYFDWLLDYWGQGTLVTVSSGGGGSGGGGSGGGGSDIQMTQSPSSLSASVGDRVTITCRASQGITNFLAWYQQKPGKAPKLLIYDASNLETGVPSRFSGSGSGTDFTLTISSLQPEDFATYYCQQSYGAPLTFGQGTRLEIK

SEQ ID NO: 266 - protein, 240 aa, Artificial Sequence
  NK77.41_CD70_DB03_A12 scFv
QVQLVQSGAEVKKPGASVKVSCKASGYTFTSYYMHWVRQAPGQGLEWMGIIDPSGGRTIYAQRFQGRVTMTRDTSTSTVYMELSSLRSEDTAVYYCARHEAGGIFDYWGQGTLVTVSSGGGGSGGGGSGGGGSDIQMTQSPSSLSASVGDRVTITCQASQDISNYLNWYQQKPGKAPKLLIYSASTLQSGVPSRFSGSGSGTDFTLTISSLQPEDFATYYCQQSYSSPYRFGQGTKVEIK

SEQ ID NO: 267 - protein, 248 aa, Artificial Sequence
  NK77.42_CD70_DB03_B01 scFv
QVQLVQSGAEVKKPGSSVKVSCKASGYTFSDSYMHWVRQAPGQGLEWVGGIIPMAGIPAYAEEFQGRVTITADESTSTAYMELSSLRSEDTAVYYCARADDYGGNWYFDLWGRGTLVTVSSGGGGSGGGGSGGGGSDIVMTQSPLSLPVTPGEPASISCRSSQSLLHSNGYNYLDWYLQKPGQSPQLLIYAASSLQSGVPDRFSGSGSGTDFTLKISRVEAEDVGVYYCMQGAHWPPTFGQGTKLEIK

SEQ ID NO: 268 - protein, 242 aa, Artificial Sequence
  NK77.43_CD70_DB03_B04 scFv
QVQLVQSGAEVKKPGASVKVSCKASGYIFTDYYMHWVRQAPGQGLEWMGIINPSGGSTSYAQKFQGRVTMTRDTSTSTVYMELSSLRSEDTAVYYCARDSGWYESWFDPWGQGTLVTVSSGGGGSGGGGSGGGGSDIQMTQSPSSLSASVGDRVTITCRASQDIRDGLGWYQQKPGKAPKLLIYAASTLQSGVPSRFSGSGSGTDFTLTISSLQPEDFATYYCQQSYGTPPTFGQGTKVEIK

SEQ ID NO: 269 - protein, 243 aa, Artificial Sequence
  NK77.44_CD70_DB03_B06 scFv
QVQLVQSGAEVKKPGASVKVSCKASGYTFTDYYLHWVRQAPGQGLEWMGWISAYNGNTNYAQKFQGRVTMTRDTSTSTVYMELSSLRSEDTAVYYCAREIVGATEDWYFDLWGRGTLVTVSSGGGGSGGGGSGGGGSEIVMTQSPATLSVSPGERATLSCRASQSVSSYLAWYQQKPGQAPRLLIYGASTRATGIPARFSGSGSGTEFTLTISSLQSEDFAVYYCQQYDSSPTFGQGTKVEIK

SEQ ID NO: 270 - protein, 241 aa, Artificial Sequence
  NK77.45_CD70_DB03_B09 scFv
QVQLVQSGAEVKKPGASVKVSCKASGYTFTAYYLHWVRQAPGQGLEWMGMINPNNGGTIYAQTFQGRVTMTRDTSTSTVYMELSSLRSEDTAVYYCARDLGGYVLFDYWGQGTLVTVSSGGGGSGGGGSGGGGSDIQMTQSPSSLSASVGDRVTITCRASQSISSYLNWYQQKPGKAPKLLIYDASNLETGVPSRFSGSGSGTDFTLTISSLQPEDFATYYCQQSHSAPITFGQGTRLEIK

SEQ ID NO: 271 - protein, 241 aa, Artificial Sequence
  NK77.46_CD70_DB03_C05 scFv
QVQLVQSGAEVKKPGASVKVSCKASGYTFTDYYIHWVRQAPGQGLEWMGMINPRGGSTTYAQSFQGRVTMTRDTSTSTVYMELSSLRSEDTAVYYCARDLGDYGDYDYWGQGTLVTVSSGGGGSGGGGSGGGGSDIQMTQSPSSLSASVGDRVTITCRASQSISTNLAWYQQKPGKAPKLLIYDASYLEAGVPSRFSGSGSGTDFTLTISSLQPEDFATYYCQQSYSTPPTFGQGTKLEIK

SEQ ID NO: 272 - protein, 252 aa, Artificial Sequence
  NK77.47_CD70_DB03_D11 scFv
EVQLLESGGGLVQPGGSLRLSCAASGFTFSNSDMNWVRQAPGKGLEWVSAISGGGDTLYYADSVKGRFTISRDNSKNTLYLQMNSLRAEDTAVYYCAMASALDSSGDNEAFDIWGQGTTVTVSSGGGGSGGGGSGGGGSDIVMTQSPDSLAVSLGERATINCKSSQSVLYSSNNKNYLAWYQQKPGQPPKLLIYWASTRDSGVPDRFSGSGSGTDFTLTISSLQAEDVAVYYCQQYYGFPPTFGQGTRLEIK

SEQ ID NO: 273 - protein, 244 aa, Artificial Sequence
  NK77.48_CD70_DB03_E01 scFv
QVQLVQSGAEVKKPGASVKVSCKASGYTFTSYYMHWVRQAPGQGLEWMGWINPNNGGTSYAQKFQGRVTMTRDTSTSTVYMELSSLRSEDTAVYYCARVEDDFWSGPSFDYWGQGTLVTVSSGGGGSGGGGSGGGGSDIQMTQSPSSLSASVGDRVTITCQASHDISKFLNWYQQKPGKAPKLLIYDASNLQRGVPSRFSGSGSGTDFTLTISSLQPEDFATYYCQQTYSFPFTFGQGTKLEIK

SEQ ID NO: 274 - protein, 246 aa, Artificial Sequence
  NK77.49_CD70_DB03_E03 scFv
QVQLVQSGAEVKKPGSSVKVSCKASGGTFTNYAFSWVRQAPGQGLEWMGGIIPISGAANYAQKFQGRVTITADESTSTAYMELSSLRSEDTAVYYCARGSGLDDAFDIWGQGTMVTVSSGGGGSGGGGSGGGGSDIVMTQSPLSLPVTPGEPASISCRSSQSLLHSNGYNYLDWYLQKPGQSPQLLIYDASSLQSGVPDRFSGSGSGTDFTLKISRVEAEDVGVYYCMQARQTPLTFGQGTRLEIK

SEQ ID NO: 275 - protein, 256 aa, Artificial Sequence
  NK77.50_CD70_DB03_E09 scFv
QVQLVQSGAEVKKPGASVKVSCKASGYTFTAYYMHWVRQAPGQGLEWMGWMNPNSGNTGYAQKFQGRVTMTRDTSTSTVYMELSSLRSEDTAVYYCAREGRIDYGDYDDYYYYYGMDVWGQGTTVTVSSGGGGSGGGGSGGGGSDIVMTQSPLSLPVTPGEPASISCRSSQSLLHSNGYNYLDWYLQKPGQSPQLLIYAASNLQGGVPDRFSGSGSGTDFTLKISRVEAEDVGVYYCMQTLESPVTFGGGTKVEIK

SEQ ID NO: 276 - protein, 242 aa, Artificial Sequence
  NK77.51_CD70_DB03_F02 scFv
QVQLVQSGAEVKKPGASVKVSCKASGYTFTDYYVHWVRQAPGQGLEWMGTINPSGGSTSYAQKFQGRVTMTRDTSTSTVYMELSSLRSEDTAVYYCARDQGLWFTGFDYWGQGTLVTVSSGGGGSGGGGSGGGGSDIQMTQSPSSLSASVGDRVTITCRASQGISNNLNWYQQKPGKAPKLLIYDASNLERGVPSRFSGSGSGTDFTLTISSLQPEDFATYYCQQSYDGPITFGQGTRLEIK

SEQ ID NO: 277 - protein, 242 aa, Artificial Sequence
  NK77.52_CD70_DB03_F05 scFv
QVQLVQSGAEVKKPGASVKVSCKASGYTFTAYHMHWVRQAPGQGLEWMGIINPGDGATGYAQNLQGRVTMTRDTSTSTVYMELSSLRSEDTAVYYCAGEGISGSDAFDIWGQGTLVTVSSGGGGSGGGGSGGGGSDIQMTQSPSSLSASVGDRVTITCRASQSISSWLAWYQQKPGKAPKLLIYAASSLQSGVPSRFSGSGSGTDFTLTISSLQPEDFATYYCLQDYSYPLTFGGGTKVEIK

SEQ ID NO: 278 - protein, 240 aa, Artificial Sequence
  NK77.53_CD70_DB03_F06 scFv
QVQLVQSGAEVKKPGSSVKVSCKASGGTFSSYAISWVRQAPGQGLEWMGWMNPNSGNTGYAQKFQGRVTITADESTSTAYMELSSLRSEDTAVYYCAWGVDPYYFDYWGQGTLVTVSSGGGGSGGGGSGGGGSDIQMTQSPSSLSASVGDRVTITCRASQSINRWLAWYQQKPGKAPKLLIYDASNLETGVPSRFSGSGSGTDFTLTISSLQPEDFATYYCQQSYITPLTFGGGTKVEIK

SEQ ID NO: 279 - protein, 240 aa, Artificial Sequence
  NK77.54_CD70_DB03_F09 scFv
QVQLVQSGAEVKKPGASVKVSCKASGYTFTSYYMHWVRQAPGQGLEWMGIFNPSDGSTSYAQKFQGRVTMTRDTSTSTVYMELSSLRSEDTAVYYCARDVGETTFDPWGQGTLVTVSSGGGGSGGGGSGGGGSDIQMTQSPSSLSASVGDRVTITCQASQDISNYLNWYQQKPGKAPKLLIYDASSLESGVPSRFSGSGSGTDFTLTISSLQPEDFATYYCQQTNSFPITFGQGTRLEIK

SEQ ID NO: 280 - protein, 245 aa, Artificial Sequence
  NK77.55_CD70_DB03_F12 scFv
QVQLVQSGAEVKKPGASVKVSCKASGYTFTSYGISWVRQAPGQGLEWMGWISAYNGHTNYAQKFQGRVTMTRDTSTSTVYMELSSLRSEDTAVYYCARDSVRGWDYYYGMGVWGQGTTVTVSSGGGGSGGGGSGGGGSDIQMTQSPSSLSASVGDRVTITCQASQDIRNFLNWYQQKPGKAPKLLIYAASTLQSGVPSRFSGSGSGTDFTLTISSLQPEDFATYYCQQSYSAPSTFGQGTKLEIK

SEQ ID NO: 281 - protein, 242 aa, Artificial Sequence
  NK77.56_CD70_DB03_G06 scFv
QVQLVQSGAEVKKPGSSVKVSCKASGYTFIDYYMHWVRQAPGQGLEWMGWMNPHSGNSDNAPKFQGRVTITADESTSTAYMELSSLRSEDTAVYYCARGYSGYDLTADYWGQGTLVTVSSGGGGSGGGGSGGGGSDIQMTQSPSSLSASVGDRVTITCRASQSISNYLNWYQQKPGKAPKLLIYDASNLETGVPSRFSGSGSGTDFTLTISSLQPEDFATYYCQQSYSTPITFGQGTRLEIK

SEQ ID NO: 282 - protein, 251 aa, Artificial Sequence
  NK77.57_CD70_DB03_G11 scFv
QVQLVQSGAEVKKPGASVKVSCKASGYTFTGQYMHWVRQAPGQGLEWMGWINPNTGDTNYAQKFQGRVTMTRDTSTSTVYMELSSLRSEDTAVYYCARDSVFEVEGGTDYYYYYGMDVWGQGTMVTVSSGGGGSGGGGSGGGGSDIQMTQSPSSLSASVGDRVTITCRASETISGWLAWYQQKPGKAPKLLIYDASNLETGVPSRFSGSGSGTDFTLTISSLQPEDFATYYCQQSYSTPWTFGQGTKLEIK

SEQ ID NO: 283 - protein, 241 aa, Artificial Sequence
  NK77.58_CD70_DB03_H08 scFv
QVQLVQSGAEVKKPGASVKVSCKASGYTFTSYDINWVRQAPGQGLEWMGVINPSGGGTSYAQKFQGRVTMTRDTSTSTVYMELSSLRSEDTAVYYCARYSGYDWVFDYWGQGTLVTVSSGGGGSGGGGSGGGGSDIQMTQSPSSLSASVGDRVTITCRASQGIGSWLAWYQQKPGKAPKLLIYAASTLQSGVPSRFSGSGSGTDFTLTISSLQPEDFATYYCQQSYSTPWTFGPGTKVDIK

SEQ ID NO: 284 - protein, 242 aa, Artificial Sequence
  NK77.59_CD70_DB03_H10 scFv
QVQLVQSGAEVKKPGASVKVSCKASGYTFANYYMHWVRQAPGQGLEWMGIINPSGGSTSYAQKFQGRVTMTRDTSTSTVYMELSSLRSEDTAVYYCARDSGSYFGWFDPWGQGTLVTVSSGGGGSGGGGSGGGGSDIQMTQSPSSLSASVGDRVTITCRASQSISSSLAWYQQKPGKAPKLLIYDASSLQSGVPSRFSGSGSGTDFTLTISSLQPEDFATYYCQQSYNTPPTFGGGTKLEIK

SEQ ID NO: 285 - protein, 242 aa, Artificial Sequence
  NK77.60_CD70_DB04_A05 scFv
QVQLVQSGAEVKKPGASVKVSCKASGYTFTTYYMHWVRQAPGQGLEWMGIINPTGGSTYYAQKFQGRVTMTRDTSTSTVYMELSSLRSEDTAVYYCARDSGNYQGIFDYWGQGTLVTVSSGGGGSGGGGSGGGGSDIQMTQSPSSLSASVGDRVTITCRASQGIGGYLAWYQQKPGKAPKLLIYDASNLETGVPSRFSGSGSGTDFTLTISSLQPEDFATYYCQQSYDSPPTFGQGTRLEIK

SEQ ID NO: 286 - protein, 241 aa, Artificial Sequence
  NK77.61_CD70_DB04_A07 scFv
QVQLVQSGAEVKKPGASVKVSCKASGNTFTSYYMHWVRQAPGQGLEWMGWINPNSGDTNYAQNFQGRVTMTRDTSTSTVYMELSSLRSEDTAVYYCARGVSGYDLFDYWGQGTLVTVSSGGGGSGGGGSGGGGSDIQMTQSPSSLSASVGDRVTITCRASQSVSSYLNWYQQKPGKAPKLLIYDTSNLETGVPSRFSGSGSGTDFTLTISSLQPEDFATYYCQQAHSFPLTFGGGTKVEIK

SEQ ID NO: 287 - protein, 241 aa, Artificial Sequence
  NK77.62_CD70_DB04_A10 scFv
EVQLVESGGGLVKPGGSLRLSCAASGFTFSSYGMHWVRQAPGKGLEWVASIKHDGSEQYYVDSVKGRFTISRDDSKNTLYLQMNSLKTEDTAVYYCAASGVDVWGQGTTVTVSSGGGGSGGGGSGGGGSDIVMTQSPLSLPVTPGEPASISCRSSQSLLHSNGYNYLDWYLQKPGQSPQLLIYLGSTRASGVPDRFSGSGSGTDFTLKISRVEAEDVGVYYCMQALDTPLTFGGGTKLEIK

SEQ ID NO: 288 - protein, 244 aa, Artificial Sequence
  NK77.63_CD70_DB04_A11 scFv
QVQLVQSGAEVKKPGASVKVSCKASGGTFSRYDINWVRQAPGQGLEWVGIIDPTGASTSYAQKFQGRVTMTRDTSTSTVYMELSSLRSEDTAVYYCARDYSYGMDYYGMDVWGQGTLVTVSSGGGGSGGGGSGGGGSDIQMTQSPSSLSASVGDRVTITCQASQDISNYLNWYQQKPGKAPKLLIYDTSNLQTGVPSRFSGSGSGTDFTLTISSLQPEDFATYYLSTDLQTTAHFGQGTKVEIK

SEQ ID NO: 289 - protein, 246 aa, Artificial Sequence
  NK77.64_CD70_DB04_B03 scFv
QVQLVQSGAEVKKPGSSVKVSCKASGYTFTSYGISWVRQAPGQGLEWMGGIIPIFGTTNYAQKFQGRVTITADESTSTAYMELSSLRSEDTAVYYCARDHSGDGYFDLWGRGTLVTVSSGGGGSGGGGSGGGGSDIVMTQSPLSLPVTPGEPASISCRSSQSLLHSNGYNYLDWYLQKPGQSPQLLIYDASSLQSGVPDRFSGSGSGTDFTLKISRVEAEDVGVYYCMQGTHWPPTFGQGTKVEIK

SEQ ID NO: 290 - protein, 240 aa, Artificial Sequence
  NK77.65_CD70_DB04_B05 scFv
QVQLVQSGAEVKKPGASVKVSCKASGYTFTENEMHWVRQAPGQGLEWMGWINPNSGGTNYAQKFQGRVTMTRDTSTSTVYMELSSLRSEDTAVYYCAGSWGGYYFDYWGQGTLVTVSSGGGGSGGGGSGGGGSDIQMTQSPSSLSASVGDRVTITCRASQSVSRYLNWYQQKPGKAPKLLIYDASNLETGVPSRFSGSGSGTDFTLTISSLQPEDFATYYCQQADSFPVTFGQGTKLEIK

SEQ ID NO: 291 - protein, 243 aa, Artificial Sequence
  NK77.66_CD70_DB04_B07 scFv
QVQLVQSGAEVKKPGASVKVSCKASGYTFTNYYIYWVRQAPGQGLEWMGWINPNDGATNYAQKFQGRVTMTRDTSTSTVYMELSSLRSEDTAVYYCAREGNDYYYYFMDYWGQGTLVTVSSGGGGSGGGGSGGGGSDIQMTQSPSSLSASVGDRVTITCRASQGISNNLNWYQQKPGKAPKLLIYHASNLETGVPSRFSGSGSGTDFTLTISSLQPEDFATYYCQQSYDGPMTFGQGTKLEIK

SEQ ID NO: 292 - protein, 249 aa, Artificial Sequence
  NK77.67_CD70_DB04_C01 scFv
QVQLVQSGAEVKKPGSSVKVSCKASGGTFSSYAISWVRQAPGQGLEWMGGITPMFGTTDYAQKFQGRVTITADESTSTAYMELSSLRSEDTAVYYCARDERDGYATVAFDIWGQGTMVTVSSGGGGSGGGGSGGGGSDIVMTQSPLSLPVTPGEPASISCRSSQSLLHSNGYNYLDWYLQKPGQSPQLLIYDASNLETGVPDRFSGSGSGTDFTLKISRVEAEDVGVYYCMQGTHWPPTFGQGTKVEIK

SEQ ID NO: 293 - protein, 244 aa, Artificial Sequence
  NK77.68_CD70_DB04_C04 scFv
QVQLVQSGAEVKKPGASVKVSCKASGYTFTSYYMHWVRQAPGQGLEWMGIINPSDGGTSYADKFQGRVTMTRDTSTSTVYMELSSLRSEDTAVYYCARALAPLGWGDGMDVWGQGTTVTVSSGGGGSGGGGSGGGGSDIQMTQSPSSLSASVGDRVTITCQASQDISNYLNWYQQKPGKAPKLLIYDASNLETGVPSRFSGSGSGTDFTLTISSLQPEDFATYYCQQSYDGPITFGQGTRLEIK

SEQ ID NO: 294 - protein, 241 aa, Artificial Sequence
  NK77.69_CD70_DB04_C06 scFv
QVQLVQSGAEVKKPGSSVKVSCKASGYTFTSYYIHWVRQAPGQGLEWMGWMNPSSGVTNFAQKFQGRVTITADESTSTAYMELSSLRSEDTAVYYCARGSDQGDWSDPWGQGTLVTVSSGGGGSGGGGSGGGGSDIQMTQSPSSLSASVGDRVTITCRASQSISSYLNWYQQKPGKAPKLLIYDASNLETGVPSRFSGSGSGTDFTLTISSLQPEDFATYYCQQSYNTPPTFGGGTKVEIK

SEQ ID NO: 295 - protein, 244 aa, Artificial Sequence
  NK77.70_CD70_DB04_C07 scFv
QVQLVQSGAEVKKPGASVKVSCKASGYTFTDSYIHWVRQAPGQGLEWIGWMNPNTGDTGYAQKFQGRVTMTRDTSTSTVYMELSSLRSEDTAVYYCAKDDFGELAPATFDPWGQGTLVTVSSGGGGSGGGGSGGGGSDIQMTQSPSSLSASVGDRVTITCQASQDISNYLNWYQQKPGKAPKLLIYGASSLQSGVPSRFSGSGSGTDFTLTISSLQPEDFATYYCLQDAATPITFGQGTRLEIK

SEQ ID NO: 296 - protein, 244 aa, Artificial Sequence
  NK77.71_CD70_DB04_D02 scFv
QVQLVQSGAEVKKPGASVKVSCKASGYTFTSYDINWVRQAPGQGLEWMGVISPSGGGTSYAQKFQGRVTMTRDTSTSTVYMELSSLRSEDTAVYYCARYYGGNPEGWYFDLWGRGTLVTVSSGGGGSGGGGSGGGGSDIQMTQSPSSLSASVGDRVTITCRASQSIGNWLAWYQQKPGKAPKLLIYDASDLETGVPSRFSGSGSGTDFTLTISSLQPEDFATYYCQQSYTTPWTFGQGTKVEIK

SEQ ID NO: 297 - protein, 259 aa, Artificial Sequence
  NK77.72_CD70_DB04_D05 scFv
EVQLLESGGGLVQPGGSLRLSCAASGFVFDDYAIHWVRQAPGKGLEWVAAISYDGSNKYYADSVKGRFTISRDNSKNTLYLQMNSLRAEDTAVYYCARAPQYYGSGTDPLEVRYYYYGMDVWGQGTTVTVSSGGGGSGGGGSGGGGSDIVMTQSPLSLPVTPGEPASISCRSSQSLLHSNGYNYLDWYLQKPGQSPQLLIYEVSNRASGVPDRFSGSGSGTDFTLKISRVEAEDVGVYYCMKGLQTPLTFGPGTKVDIK

SEQ ID NO: 298 - protein, 244 aa, Artificial Sequence
  NK77.73_CD70_DB04_D07 scFv
QVQLVQSGAEVKKPGSSVKVSCKASGGTFRNYAISWVRQAPGQGLEWMGGIIPIFGTANYAQKFQGRVTITADESTSTAYMELSSLRSEDTAVYYCARDHSAGTHHDAFDIWGQGTMVTVSSGGGGSGGGGSGGGGSDIQMTQSPSSLSASVGDRVTITCRASQGISNYLAWYQQKPGKAPKLLIYAASSLQSGVPSRFSGSGSGTDFTLTISSLQPEDFATYYCQQSHSTPLTFGQGTKVEIK

SEQ ID NO: 299 - protein, 239 aa, Artificial Sequence
  NK77.74_CD70_DB04_D08 scFv
QVQLVQSGAEVKKPGASVKVSCKASGYTFTSYYIHWVRQAPGQGLEWMGWMNPNSGNAGYAQKFQGRVTMTRDTSTSTVYMELSSLRSEDTAVYYCAREYWGSFDYWGQGTLVTVSSGGGGSGGGGSGGGGSDIQMTQSPSSLSASVGDRVTITCRASQGISNNLNWYQQKPGKAPKLLIYDASNLETGVPSRFSGSGSGTDFTLTISSLQPEDFATYYCQQSYSTPYTFGQGTKVEIK

SEQ ID NO: 300 - protein, 240 aa, Artificial Sequence
  NK77.75_CD70_DB04_D10 scFv
QVQLVQSGAEVKKPGASVKVSCKASGYTFTGYYMHWVRQAPGQGLEWMGMIDPSDGSTIYAQKFQGRVTMTRDTSTSTVYMELSSLRSEDTAVYYCARERPLYASDLWGQGTLVTVSSGGGGSGGGGSGGGGSDIQMTQSPSSLSASVGDRVTITCRASQDIGNDLGWYQQKPGKAPKLLIYAASSLQSGVPSRFSGSGSGTDFTLTISSLQPEDFATYYCLQDYDYPLTFGQGTKVEIK

SEQ ID NO: 301 - protein, 241 aa, Artificial Sequence
  NK77.85_CD70_DB03_B02 scFv
QVQLVQSGAEVKKPGSSVKVSCKASGYTFTNYYMHWVRQAPGQGLEWMGWMNPDSGNTGYAQKFQGRVTITADESTSTAYMELSSLRSEDTAVYYCARSSSSWPDFDLWGRGTLVTVSSGGGGSGGGGSGGGGSDIQMTQSPSSLSASVGDRVTITCRASQSISSYLNWYQQKPGKAPKLLIYDASNLETGVPSRFSGSGSGTDFTLTISSLQPEDFATYYCQQSYNTPYSFGQGTKVEIK

SEQ ID NO: 302 - protein, 242 aa, Artificial Sequence
  NK77.86_CD70_DB04_A06 scFv
QVQLVQSGAEVKKPGASVKVSCKASGYTFTSYSMHWVRQAPGQGLEWVGIINPSSGSASYAQKFQGRVTMTRDTSTSTVYMELSSLRSEDTAVYYCARERGAYSSTFDYWGQGTLVTVSSGGGGSGGGGSGGGGSDIQMTQSPSSLSASVGDRVTITCRTSQSISSYLNWYQQKPGKAPKLLIYDASNLETGVPSRFSGSGSGTDFTLTISSLQPEDFATYYCLQDYSYPLTFGQGTKVEIK

SEQ ID NO: 303 - protein, 242 aa, Artificial Sequence
  NK77.87_CD70_DB04_A09 scFv
QVQLVQSGAEVKKPGASVKVSCKASGYTFTDYYMHWVRQAPGQGLEWMGVINPSDGTAHYAQRLQGRVTMTRDTSTSTVYMELSSLRSEDTAVYYCARDSGSYYADFDYWGQGTLVTVSSGGGGSGGGGSGGGGSDIQMTQSPSSLSASVGDRVTITCQASQDISNYLNWYQQKPGKAPKLLIYDASSLQSGVPSRFSGSGSGTDFTLTISSLQPEDFATYYCQQSYSTPPAFGQGTKVEIK

SEQ ID NO: 304 - protein, 507 aa, Artificial Sequence
  NK77.76_38-38 scFv
QVQLVQSGAEVKKPGASVKVSCKASGYSFTSYYMHWVRQAPGQGLEWMGIINPSGGTTSYAQKFQGRVTMTRDTSTSTVYMELSSLRSEDTAVYYCARDNSPYSSSWWDYFDYWGQGTLVTVSSGGGGSGGGGSGGGGSDIQMTQSPSSLSASVGDRVTITCRASQDIRHYLAWYQQKPGKAPKLLIYDASSLQSGVPSRFSGSGSGTDFTLTISSLQPEDFATYYCQQTYDAPITFGQGTRLEIKGGGGSGGGGSGGGGSQVQLVQSGAEVKKPGASVKVSCKASGYSFTSYYMHWVRQAPGQGLEWMGIINPSGGTTSYAQKFQGRVTMTRDTSTSTVYMELSSLRSEDTAVYYCARDNSPYSSSWWDYFDYWGQGTLVTVSSGGGGSGGGGSGGGGSDIQMTQSPSSLSASVGDRVTITCRASQDIRHYLAWYQQKPGKAPKLLIYDASSLQSGVPSRFSGSGSGTDFTLTISSLQPEDFATYYCQQTYDAPITFGQGTRLEIK

SEQ ID NO: 305 - protein, 507 aa, Artificial Sequence
  NK77.77_64-64 scFv
QVQLVQSGAEVKKPGSSVKVSCKASGYTFTSYGISWVRQAPGQGLEWMGGIIPIFGTTNYAQKFQGRVTITADESTSTAYMELSSLRSEDTAVYYCARDHSGDGYFDLWGRGTLVTVSSGGGGSGGGGSGGGGSDIVMTQSPLSLPVTPGEPASISCRSSQSLLHSNGYNYLDWYLQKPGQSPQLLIYDASSLQSGVPDRFSGSGSGTDFTLKISRVEAEDVGVYYCMQGTHWPPTFGQGTKVEIKGGGGSGGGGSGGGGSQVQLVQSGAEVKKPGSSVKVSCKASGYTFTSYGISWVRQAPGQGLEWMGGIIPIFGTTNYAQKFQGRVTITADESTSTAYMELSSLRSEDTAVYYCARDHSGDGYFDLWGRGTLVTVSSGGGGSGGGGSGGGGSDIVMTQSPLSLPVTPGEPASISCRSSQSLLHSNGYNYLDWYLQKPGQSPQLLIYDASSLQSGVPDRFSGSGSGTDFTLKISRVEAEDVGVYYCMQGTHWPPTFGQGTKVEIK

SEQ ID NO: 306 - protein, 495 aa, Artificial Sequence
  NK77.78_65-65 scFv
QVQLVQSGAEVKKPGASVKVSCKASGYTFTENEMHWVRQAPGQGLEWMGWINPNSGGTNYAQKFQGRVTMTRDTSTSTVYMELSSLRSEDTAVYYCAGSWGGYYFDYWGQGTLVTVSSGGGGSGGGGSGGGGSDIQMTQSPSSLSASVGDRVTITCRASQSVSRYLNWYQQKPGKAPKLLIYDASNLETGVPSRFSGSGSGTDFTLTISSLQPEDFATYYCQQADSFPVTFGQGTKLEIKGGGGSGGGGSGGGGSQVQLVQSGAEVKKPGASVKVSCKASGYTFTENEMHWVRQAPGQGLEWMGWINPNSGGTNYAQKFQGRVTMTRDTSTSTVYMELSSLRSEDTAVYYCAGSWGGYYFDYWGQGTLVTVSSGGGGSGGGGSGGGGSDIQMTQSPSSLSASVGDRVTITCRASQSVSRYLNWYQQKPGKAPKLLIYDASNLETGVPSRFSGSGSGTDFTLTISSLQPEDFATYYCQQADSFPVTFGQGTKLEIK

SEQ ID NO: 307 - protein, 510 aa, Artificial Sequence
  NK77.79_38-67 scFv
QVQLVQSGAEVKKPGASVKVSCKASGYSFTSYYMHWVRQAPGQGLEWMGIINPSGGTTSYAQKFQGRVTMTRDTSTSTVYMELSSLRSEDTAVYYCARDNSPYSSSWWDYFDYWGQGTLVTVSSGGGGSGGGGSGGGGSDIQMTQSPSSLSASVGDRVTITCRASQDIRHYLAWYQQKPGKAPKLLIYDASSLQSGVPSRFSGSGSGTDFTLTISSLQPEDFATYYCQQTYDAPITFGQGTRLEIKGGGGSGGGGSGGGGSQVQLVQSGAEVKKPGSSVKVSCKASGGTFSSYAISWVRQAPGQGLEWMGGITPMFGTTDYAQKFQGRVTITADESTSTAYMELSSLRSEDTAVYYCARDERDGYATVAFDIWGQGTMVTVSSGGGGSGGGGSGGGGSDIVMTQSPLSLPVTPGEPASISCRSSQSLLHSNGYNYLDWYLQKPGQSPQLLIYDASNLETGVPDRFSGSGSGTDFTLKISRVEAEDVGVYYCMQGTHWPPTFGQGTKVEIK

SEQ ID NO: 308 - protein, 505 aa, Artificial Sequence
  NK77.80_38-68 scFv
QVQLVQSGAEVKKPGASVKVSCKASGYSFTSYYMHWVRQAPGQGLEWMGIINPSGGTTSYAQKFQGRVTMTRDTSTSTVYMELSSLRSEDTAVYYCARDNSPYSSSWWDYFDYWGQGTLVTVSSGGGGSGGGGSGGGGSDIQMTQSPSSLSASVGDRVTITCRASQDIRHYLAWYQQKPGKAPKLLIYDASSLQSGVPSRFSGSGSGTDFTLTISSLQPEDFATYYCQQTYDAPITFGQGTRLEIKGGGGSGGGGSGGGGSQVQLVQSGAEVKKPGASVKVSCKASGYTFTSYYMHWVRQAPGQGLEWMGIINPSDGGTSYADKFQGRVTMTRDTSTSTVYMELSSLRSEDTAVYYCARALAPLGWGDGMDVWGQGTTVTVSSGGGGSGGGGSGGGGSDIQMTQSPSSLSASVGDRVTITCQASQDISNYLNWYQQKPGKAPKLLIYDASNLETGVPSRFSGSGSGTDFTLTISSLQPEDFATYYCQQSYDGPITFGQGTRLEIK

SEQ ID NO: 309 - protein, 510 aa, Artificial Sequence
  NK77.81_64-67 scFv
QVQLVQSGAEVKKPGSSVKVSCKASGYTFTSYGISWVRQAPGQGLEWMGGIIPIFGTTNYAQKFQGRVTITADESTSTAYMELSSLRSEDTAVYYCARDHSGDGYFDLWGRGTLVTVSSGGGGSGGGGSGGGGSDIVMTQSPLSLPVTPGEPASISCRSSQSLLHSNGYNYLDWYLQKPGQSPQLLIYDASSLQSGVPDRFSGSGSGTDFTLKISRVEAEDVGVYYCMQGTHWPPTFGQGTKVEIKGGGGSGGGGSGGGGSQVQLVQSGAEVKKPGSSVKVSCKASGGTFSSYAISWVRQAPGQGLEWMGGITPMFGTTDYAQKFQGRVTITADESTSTAYMELSSLRSEDTAVYYCARDERDGYATVAFDIWGQGTMVTVSSGGGGSGGGGSGGGGSDIVMTQSPLSLPVTPGEPASISCRSSQSLLHSNGYNYLDWYLQKPGQSPQLLIYDASNLETGVPDRFSGSGSGTDFTLKISRVEAEDVGVYYCMQGTHWPPTFGQGTKVEIK

SEQ ID NO: 310 - protein, 505 aa, Artificial Sequence
  NK77.82_64-68 scFv
QVQLVQSGAEVKKPGSSVKVSCKASGYTFTSYGISWVRQAPGQGLEWMGGIIPIFGTTNYAQKFQGRVTITADESTSTAYMELSSLRSEDTAVYYCARDHSGDGYFDLWGRGTLVTVSSGGGGSGGGGSGGGGSDIVMTQSPLSLPVTPGEPASISCRSSQSLLHSNGYNYLDWYLQKPGQSPQLLIYDASSLQSGVPDRFSGSGSGTDFTLKISRVEAEDVGVYYCMQGTHWPPTFGQGTKVEIKGGGGSGGGGSGGGGSQVQLVQSGAEVKKPGASVKVSCKASGYTFTSYYMHWVRQAPGQGLEWMGIINPSDGGTSYADKFQGRVTMTRDTSTSTVYMELSSLRSEDTAVYYCARALAPLGWGDGMDVWGQGTTVTVSSGGGGSGGGGSGGGGSDIQMTQSPSSLSASVGDRVTITCQASQDISNYLNWYQQKPGKAPKLLIYDASNLETGVPSRFSGSGSGTDFTLTISSLQPEDFATYYCQQSYDGPITFGQGTRLEIK

SEQ ID NO: 311 - protein, 504 aa, Artificial Sequence
  NK77.83_65-67 scFv
QVQLVQSGAEVKKPGASVKVSCKASGYTFTENEMHWVRQAPGQGLEWMGWINPNSGGTNYAQKFQGRVTMTRDTSTSTVYMELSSLRSEDTAVYYCAGSWGGYYFDYWGQGTLVTVSSGGGGSGGGGSGGGGSDIQMTQSPSSLSASVGDRVTITCRASQSVSRYLNWYQQKPGKAPKLLIYDASNLETGVPSRFSGSGSGTDFTLTISSLQPEDFATYYCQQADSFPVTFGQGTKLEIKGGGGSGGGGSGGGGSQVQLVQSGAEVKKPGSSVKVSCKASGGTFSSYAISWVRQAPGQGLEWMGGITPMFGTTDYAQKFQGRVTITADESTSTAYMELSSLRSEDTAVYYCARDERDGYATVAFDIWGQGTMVTVSSGGGGSGGGGSGGGGSDIVMTQSPLSLPVTPGEPASISCRSSQSLLHSNGYNYLDWYLQKPGQSPQLLIYDASNLETGVPDRFSGSGSGTDFTLKISRVEAEDVGVYYCMQGTHWPPTFGQGTKVEIK

SEQ ID NO: 312 - protein, 499 aa, Artificial Sequence
  NK77.84_65-68 scFv
QVQLVQSGAEVKKPGASVKVSCKASGYTFTENEMHWVRQAPGQGLEWMGWINPNSGGTNYAQKFQGRVTMTRDTSTSTVYMELSSLRSEDTAVYYCAGSWGGYYFDYWGQGTLVTVSSGGGGSGGGGSGGGGSDIQMTQSPSSLSASVGDRVTITCRASQSVSRYLNWYQQKPGKAPKLLIYDASNLETGVPSRFSGSGSGTDFTLTISSLQPEDFATYYCQQADSFPVTFGQGTKLEIKGGGGSGGGGSGGGGSQVQLVQSGAEVKKPGASVKVSCKASGYTFTSYYMHWVRQAPGQGLEWMGIINPSDGGTSYADKFQGRVTMTRDTSTSTVYMELSSLRSEDTAVYYCARALAPLGWGDGMDVWGQGTTVTVSSGGGGSGGGGSGGGGSDIQMTQSPSSLSASVGDRVTITCQASQDISNYLNWYQQKPGKAPKLLIYDASNLETGVPSRFSGSGSGTDFTLTISSLQPEDFATYYCQQSYDGPITFGQGTRLEIK

SEQ ID NO: 313 - protein, 722 aa, Artificial Sequence
  NK77.1_CD70_DB01_C03 construct
MALPVTALLLPLALLLHAARPDYKDDDDKGGGGSGGGGSQVQLVQSGAEVKKPGASVKVSCKASGYTFTGHYLHWVRQAPGQGLEWMGWINPNSGGTNYAQKFQGRVTMTRDTSTSTVYMELSSLRSEDTAVYYCVRGSGWYDLDYWGQGTLVTVSSGGGGSGGGGSGGGGSDIQMTQSPSSLSASVGDRVTITCRASQNIGTYLAWYQQKPGKAPKLLIYDASNLETGVPSRFSGSGSGTDFTLTISSLQPEDFATYYCQQSYRIPLTFGQGTRLEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 314 - protein, 723 aa, Artificial Sequence
  NK77.2_CD70_DB01_D02 construct
MALPVTALLLPLALLLHAARPDYKDDDDKGGGGSGGGGSQVQLVQSGAEVKKPGASVKVSCKASGYTFTNYYMHWVRQAPGQGLEWMGIINPSGGSTSYAQKFQGRVTMTRDTSTSTVYMELSSLRSEDTAVYYCARELGVAGYFDLWGRGTLVTVSSGGGGSGGGGSGGGGSDIQMTQSPSSLSASVGDRVTITCRASQRISNWLAWYQQKPGKAPKLLIYDASNLETGVPSRFSGSGSGTDFTLTISSLQPEDFATYYCQQTYSPPPTFGQGTKLEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 315 - protein, 732 aa, Artificial Sequence
  NK77.3_CD70_DB01_E06 construct
MALPVTALLLPLALLLHAARPDYKDDDDKGGGGSGGGGSQVQLVQSGAEVKKPGASVKVSCKASGYTFTGYYIHWVRQAPGQGLEWMGIINPSGGSTSYAQKFQGRVTMTRDTSTSTVYMELSSLRSEDTAVYYCARDLSGIDGYIGFFDYWGQGTLVTVSSGGGGSGGGGSGGGGSDIVMTQSPLSLPVTPGEPASISCRSSQSLLHSNGYNYLDWYLQKPGQSPQLLIYAASSLQSGVPDRFSGSGSGTDFTLKISRVEAEDVGVYYCMQALQTPITFGQGTRLEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 316 - protein, 723 aa, Artificial Sequence
  NK77.4_CD70_DB01_G04 construct
MALPVTALLLPLALLLHAARPDYKDDDDKGGGGSGGGGSQVQLVQSGAEVKKPGASVKVSCKASGGTFRSHVISWVRQAPGQGLEWMGIIDPSGGSTSYAQRFQGRVTMTRDTSTSTVYMELSSLRSEDTAVYYCAKDYTGLLGMDVWGQGTTVTVSSGGGGSGGGGSGGGGSDIQMTQSPSSLSASVGDRVTITCRASQDIDTYLAWYQQKPGKAPKLLIYAASSLQSGVPSRFSGSGSGTDFTLTISSLQPEDFATYYCQQSYTTPFTFGQGTKVEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 317 - protein, 723 aa, Artificial Sequence
  NK77.5_CD70_DB01_G05 construct
MALPVTALLLPLALLLHAARPDYKDDDDKGGGGSGGGGSQVQLVQSGAEVKKPGASVKVSCKASGYTFIDYYIHWVRQAPGQGLEWMGWMNPNSGNTGYAQKFQGRVTMTRDTSTSTVYMELSSLRSEDTAVYYCARGLSGYDLDDYWGQGTLVTVSSGGGGSGGGGSGGGGSDIQMTQSPSSLSASVGDRVTITCQASQDISNYLNWYQQKPGKAPKLLIYDASSLESGVPSRFSGSGSGTDFTLTISSLQPEDFATYYCQQSYRSPLTFGGGTKVEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 318 - protein, 722 aa, Artificial Sequence
  NK77.6_CD70_DB01_G07 construct
MALPVTALLLPLALLLHAARPDYKDDDDKGGGGSGGGGSQVQLVQSGAEVKKPGASVKVSCKASGYTFTSYYMHWVRQAPGQGLEWMGWINPNSGGTKYAHKFQGRVTMTRDTSTSTVYMELSSLRSEDTAVYYCARGLSGYDFDYWGQGTTVTVSSGGGGSGGGGSGGGGSDIQMTQSPSSLSASVGDRVTITCQASQDISNYLNWYQQKPGKAPKLLIYDASNLETGVPSRFSGSGSGTDFTLTISSLQPEDFATYYCQQAYRWPITFGQGTRLEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 319 - protein, 723 aa, Artificial Sequence
  NK77.7_CD70_DB01_G11 construct
MALPVTALLLPLALLLHAARPDYKDDDDKGGGGSGGGGSQVQLVQSGAEVKKPGASVKVSCKASGYTFTGYYMHWVRQAPGQGLEWMGWMNPNSGNTGYAQKFQGRVTMTRDTSTSTVYMELSSLRSEDTAVYYCARGTDVYGDFDYWGQGTLVTVSSGGGGSGGGGSGGGGSDIQMTQSPSSLSASVGDRVTITCRASQSISSYLNWYQQKPGKAPKLLIYDASYLETGVPSRFSGSGSGTDFTLTISSLQPEDFATYYCQQSYTIPPTFGQGTKVEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 320 - protein, 730 aa, Artificial Sequence
  NK77.9_CD70_DB02_A03 construct
MALPVTALLLPLALLLHAARPDYKDDDDKGGGGSGGGGSQVQLVQSGAEVKKPGSSVKVSCKASGYTFTENEMHWVRQAPGQGLEWMGGIIPIFGTANYAQKFQGRVTITADESTSTAYMELSSLRSEDTAVYYCAREGGTAMATGYYYYGMDVWGQGTTVTVSSGGGGSGGGGSGGGGSDIQMTQSPSSLSASVGDRVTITCQASQDISNYLNWYQQKPGKAPKLLIYDASNLETGVPSRFSGSGSGTDFTLTISSLQPEDFATYYCQQSYSTPLTFGQGTKVEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 321 - protein, 728 aa, Artificial Sequence
  NK77.10_CD70_DB02_A04 construct
MALPVTALLLPLALLLHAARPDYKDDDDKGGGGSGGGGSQVQLVQSGAEVKKPGASVKVSCKASGYTFTENEMHWVRQAPGQGLEWMGWINSNGGYTGYALKFQGRVTMTRDTSTSTVYMELSSLRSEDTAVYYCARASNYGGHFDYWGQGTLVTVSSGGGGSGGGGSGGGGSDIVMTQSPLSLPVTPGEPASISCRSSQSLLHSNGYNYLDWYLQKPGQSPQLLIYQASSLESGVPDRFSGSGSGTDFTLKISRVEAEDVGVYYCMQGTHWPPTFGGGTKVEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 322 - protein, 723 aa, Artificial Sequence
  NK77.11_CD70_DB02_A05 construct
MALPVTALLLPLALLLHAARPDYKDDDDKGGGGSGGGGSQVQLVQSGAEVKKPGASVKVSCKASGYTFTSYYMHWVRQAPGQGLEWMGIINPSGGSTIYAQKFQGRVTMTRDTSTSTVYMELSSLRSEDTAVYYCAKDMGAWAAGFDYWGQGTLVTVSSGGGGSGGGGSGGGGSDIQMTQSPSSLSASVGDRVTITCQASQDISNYLNWYQQKPGKAPKLLIYATSTLANGVPSRFSGSGSGTDFTLTISSLQPEDFATYYCQQSYSTLTFGQGTRLEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 323 - protein, 724 aa, Artificial Sequence
  NK77.12_CD70_DB02_A06 construct
MALPVTALLLPLALLLHAARPDYKDDDDKGGGGSGGGGSQVQLVQSGAEVKKPGASVKVSCKASGYTFTGYYMHWVRQAPGQGLEWMGWINPNSGDTGYAQKFQGRVTMTRDTSTSTVYMELSSLRSEDTAVYYCARSVNDYGDYDGYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTLTISSLQPEDFATYYCQQSYSTPPTFGQGTKVEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 324 - protein, 724 aa, Artificial Sequence
  NK77.13_CD70_DB02_A07 construct
MALPVTALLLPLALLLHAARPDYKDDDDKGGGGSGGGGSQVQLVQSGAEVKKPGASVKVSCKASGYTFTGYYMHWVRQAPGQGLEWMGIINPSGGSTSYAQKFQGRVTMTRDTSTSTVYMELSSLRSEDTAVYYCARDYGDYDASFDYWGQGTLVTVSSGGGGSGGGGSGGGGSDIQMTQSPSSLSASVGDRVTITCRASQSIDNWLAWYQQKPGKAPKLLIYAASTLQSGVPSRFSGSGSGTDFTLTISSLQPEDFATYYCQQSYDSPPTFGQGTKLEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 325 - protein, 721 aa, Artificial Sequence
  NK77.14_CD70_DB02_A08 construct
MALPVTALLLPLALLLHAARPDYKDDDDKGGGGSGGGGSQVQLVQSGAEVKKPGASVKVSCKASGYTFTSYDINWVRQAPGQGLEWMGIINPSDGSTIYAQNFQGRVTMTRDTSTSTVYMELSSLRSEDTAVYYCVKEEAWYFDLWGRGTLVTVSSGGGGSGGGGSGGGGSDIQMTQSPSSLSASVGDRVTITCQASQDISNYLNWYQQKPGKAPKLLIYDASNLETGVPSRFSGSGSGTDFTLTISSLQPEDFATYYCQQSYSTPLTFGGGTKVEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 326 - protein, 721 aa, Artificial Sequence
  NK77.15_CD70_DB02_A09 construct
MALPVTALLLPLALLLHAARPDYKDDDDKGGGGSGGGGSQVQLVQSGAEVKKPGASVKVSCKASGYTFTSYYMHWVRQAPGQGLEWMGWMNPDNGDTGYAQMFQGRVTMTRDTSTSTVYMELSSLRSEDTAVYYCASGDYYDILYWGQGTLVTVSSGGGGSGGGGSGGGGSDIQMTQSPSSLSASVGDRVTITCQASQDISNYLNWYQQKPGKAPKLLIYDVSNLETGVPSRFSGSGSGTDFTLTISSLQPEDFATYYCQQANSFPLTFGGGTKVEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 327 - protein, 722 aa, Artificial Sequence
  NK77.16_CD70_DB02_A11 construct
MALPVTALLLPLALLLHAARPDYKDDDDKGGGGSGGGGSQVQLVQSGAEVKKPGASVKVSCKASGYTFTSYYMHWVRQAPGQGLEWMGWMNPNSGDTGYAQKFQGRVTMTRDTSTSTVYMELSSLRSEDTAVYYCARGPSGYEFDYWGQGTLVTVSSGGGGSGGGGSGGGGSDIQMTQSPSSLSASVGDRVTITCRASQTISNYLNWYQQKPGKAPKLLIYDASSLESGVPSRFSGSGSGTDFTLTISSLQPEDFATYYCQQAISFPLTFGGGTKVEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 328 - protein, 726 aa, Artificial Sequence
  NK77.17_CD70_DB02_B06 construct
MALPVTALLLPLALLLHAARPDYKDDDDKGGGGSGGGGSQVQLVQSGAEVKKPGASVKVSCKASGYTFTDYYMHWVRQAPGQGLEWMGIINPNSGGTNYAQKFQGRVTMTRDTSTSTVYMELSSLRSEDTAVYYCARDFSVYAAADGMDVWGQGTLVTVSSGGGGSGGGGSGGGGSDIQMTQSPSSLSASVGDRVTITCRASQSISSYLNWYQQKPGKAPKLLIYDASNLATGVPSRFSGSGSGTDFTLTISSLQPEDFATYYCQQSDSSPLTFGQGTKVEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 329 - protein, 725 aa, Artificial Sequence
  NK77.18_CD70_DB02_B09 construct
MALPVTALLLPLALLLHAARPDYKDDDDKGGGGSGGGGSQVQLVQSGAEVKKPGASVKVSCKASGYTFTGYYMHWVRQAPGQGLEWMGIINPGDGGTIYAQNFQGRVTMTRDTSTSTVYMELSSLRSEDTAVYYCARGFGESAPDAFDIWGQGTMVTVSSGGGGSGGGGSGGGGSDIQMTQSPSSLSASVGDRVTITCQASQDISNYLNWYQQKPGKAPKLLIYGATTLQSGVPSRFSGSGSGTDFTLTISSLQPEDFATYYCQQADSFPYTFGQGTKLEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 330 - protein, 722 aa, Artificial Sequence
  NK77.19_CD70_DB02_C03 construct
MALPVTALLLPLALLLHAARPDYKDDDDKGGGGSGGGGSQVQLVQSGAEVKKPGASVKVSCKASGYTFTGYYMHWVRQAPGQGLEWMGIINPSGGSTSYAQKFQGRVTMTRDTSTSTVYMELSSLRSEDTAVYYCAAGTEIYYMDVWGKGTTVTVSSGGGGSGGGGSGGGGSDIQMTQSPSSLSASVGDRVTITCRASQTIDIYLNWYQQKPGKAPKLLIYDASNLETGVPSRFSGSGSGTDFTLTISSLQPEDFATYYCQQADSFPLTFGGGTKVEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 331 - protein, 731 aa, Artificial Sequence
  NK77.20_CD70_DB02_C04 construct
MALPVTALLLPLALLLHAARPDYKDDDDKGGGGSGGGGSQVQLVQSGAEVKKPGASVKVSCKASGGTFSSYAISWVRQAPGQGLEWMGMINPSDGATTYAQKFQGRVTMTRDTSTSTVYMELSSLRSEDTAVYYCARERELLHFATNYYYYGMDVWGQGTTVTVSSGGGGSGGGGSGGGGSDIQMTQSPSSLSASVGDRVTITCRASQGISNNLNWYQQKPGKAPKLLIYAASSLHSGVPSRFSGSGSGTDFTLTISSLQPEDFATYYCQQADAFPLTFGGGTKVEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 332 - protein, 727 aa, Artificial Sequence
  NK77.22_CD70_DB02_C07 construct
MALPVTALLLPLALLLHAARPDYKDDDDKGGGGSGGGGSQVQLVQSGAEVKKPGASVKVSCKASGYTFTRNYMHWVRQAPGQGLEWMGWISPDNGVTNYAQNFQGRVTMTRDTSTSTVYMELSSLRSEDTAVYYCAKTQGSSSWYQWYFDLWGRGTLVTVSSGGGGSGGGGSGGGGSDIQMTQSPSSLSASVGDRVTITCRASQSIGTWLAWYQQKPGKAPKLLIYAASSLQSGVPSRFSGSGSGTDFTLTISSLQPEDFATYYCQQSYTTPITFGQGTKVEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 333 - protein, 723 aa, Artificial Sequence
  NK77.24_CD70_DB02_D02 construct
MALPVTALLLPLALLLHAARPDYKDDDDKGGGGSGGGGSQVQLVQSGAEVKKPGASVKVSCKASGYTFTSYYMHWVRQAPGQGLEWMGIIDPGSGDTSYAQKFQGRVTMTRDTSTSTVYMELSSLRSEDTAVYYCARGSNWYDYFDYWGQGTLVTVSSGGGGSGGGGSGGGGSEIVMTQSPATLSVSPGERATLSCRASQSVSSYLAWYQQKPGQAPRLLIYGASTRATGIPARFSGSGSGTEFTLTISSLQSEDFAVYYCQQYDSYPPTFGGGTKVEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 334 - protein, 723 aa, Artificial Sequence
  NK77.25_CD70_DB02_D04 construct
MALPVTALLLPLALLLHAARPDYKDDDDKGGGGSGGGGSQVQLVQSGAEVKKPGASVKVSCKASGYRLSDHYMHWVRQAPGQGLEWMGIINPSGGSTTYAQNFQGRVTMTRDTSTSTVYMELSSLRSEDTAVYYCASSYYGDYVLVNWGQGTLVTVSSGGGGSGGGGSGGGGSDIQMTQSPSSLSASVGDRVTITCQASQDISNYLNWYQQKPGKAPKLLIYAASTLESGVPSRFSGSGSGTDFTLTISSLQPEDFATYYCLQDYDYPLTFGQGTKLEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 335 - protein, 724 aa, Artificial Sequence
  NK77.26_CD70_DB02_D10 construct
MALPVTALLLPLALLLHAARPDYKDDDDKGGGGSGGGGSQVQLVQSGAEVKKPGASVKVSCKASGYTFTDYYVHWVRQAPGQGLEWMGWINPNTGGTSFAQNFQGRVTMTRDTSTSTVYMELSSLRSEDTAVYYCARDLGQWLGEIDYWGQGTLVTVSSGGGGSGGGGSGGGGSDIQMTQSPSSLSASVGDRVTITCRASQTIYKWLAWYQQKPGKAPKLLIYDASSLESGVPSRFSGSGSGTDFTLTISSLQPEDFATYYCQQANSFPFTFGPGTKVDIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 336 - protein, 728 aa, Artificial Sequence
  NK77.27_CD70_DB02_D11 construct
MALPVTALLLPLALLLHAARPDYKDDDDKGGGGSGGGGSQVQLVQSGAEVKKPGASVKVSCKASGYTFTDYTDYFVHWVRQAPGQGLEWMGIFNPSDGSTSYAQEFQGRVTMTRDTSTSTVYMELSSLRSEDTAVYYCARGPYSSSWYYFDYWGQGTLVTVSSGGGGSGGGGSGGGGSDIQMTQSPSSLSASVGDRVTITCQASQDISNYLNWYQQKPGKAPKLLIYDASNLETGVPSRFSGSGSGTDFTLTISSLQPEDFATYYCQQAHSFPPTFGQGTKVEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 337 - protein, 724 aa, Artificial Sequence
  NK77.28_CD70_DB02_E04 construct
MALPVTALLLPLALLLHAARPDYKDDDDKGGGGSGGGGSQVQLVQSGAEVKKPGASVKVSCKASGYIFTDYYMHWVRQAPGQGLEWMGIINPSGGDTLYAQKFQGRVTMTRDTSTSTVYMELSSLRSEDTAVYYCAREGVGAMGVFDYWGQGTLVTVSSGGGGSGGGGSGGGGSDIQMTQSPSSLSASVGDRVTITCRASTSISDYVHWYQQKPGKAPKLLIYDASSLQSGVPSRFSGSGSGTDFTLTISSLQPEDFATYYCQQSDSTPPTFGGGTKVEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 338 - protein, 726 aa, Artificial Sequence
  NK77.29_CD70_DB02_F06 construct
MALPVTALLLPLALLLHAARPDYKDDDDKGGGGSGGGGSQVQLVQSGAEVKKPGASVKVSCKASGYTFTDHYIHWVRQAPGQGLEWMGWISAYNGKTNYAQKFQGRVTMTRDTSTSTVYMELSSLRSEDTAVYYCARDTIYYDFWSGYDYWGQGTLVTVSSGGGGSGGGGSGGGGSDIQMTQSPSSLSASVGDRVTITCRASQGISNNLNWYQQKPGKAPKLLIYYASTLQSGVPSRFSGSGSGTDFTLTISSLQPEDFATYYCQQSYSTPITFGQGTRLEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 339 - protein, 726 aa, Artificial Sequence
  NK77.31_CD70_DB02_F08 construct
MALPVTALLLPLALLLHAARPDYKDDDDKGGGGSGGGGSQVQLVQSGAEVKKPGASVKVSCKASGYTFTSYYMHWVRQAPGQGLEWMGIINPSGGATIYAQKFQGRVTMTRDTSTSTVYMELSSLRSEDTAVYYCARSRGDYYGSGDFDYWGQGTLVTVSSGGGGSGGGGSGGGGSDIQMTQSPSSLSASVGDRVTITCRASQTISNYLNWYQQKPGKAPKLLIYDASTLEAGVPSRFSGSGSGTDFTLTISSLQPEDFATYYCQQSYNPPYTFGQGTKLEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 340 - protein, 722 aa, Artificial Sequence
  NK77.32_CD70_DB02_G07 construct
MALPVTALLLPLALLLHAARPDYKDDDDKGGGGSGGGGSQVQLVQSGAEVKKPGASVKVSCKASGYTFTDYYMHWVRQAPGQGLEWMGIINPSGGSTSYAQKFQGRVTMTRDTSTSTVYMELSSLRSEDTAVYYCARGYFDHAFDIWGQGTMVTVSSGGGGSGGGGSGGGGSDIQMTQSPSSLSASVGDRVTITCRASQSISTYLNWYQQKPGKAPKLLIYDASNLEIGVPSRFSGSGSGTDFTLTISSLQPEDFATYYCQQSDSSPLTFGQGTKVEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 341 - protein, 728 aa, Artificial Sequence
  NK77.33_CD70_DB02_H04 construct
MALPVTALLLPLALLLHAARPDYKDDDDKGGGGSGGGGSQVQLVQSGAEVKKPGASVKVSCKASGYTFTGYYMHWVRQAPGQGLEWMGIINPSGGDTIYAQKFQGRVTMTRDTSTSTVYMELSSLRSEDTAVYYCARGDSSSWYDYYYYMDVWGKGTTVTVSSGGGGSGGGGSGGGGSDIQMTQSPSSLSASVGDRVTITCQASQDISNYLNWYQQKPGKAPKLLIYAASSLQSGVPSRFSGSGSGTDFTLTISSLQPEDFATYYCQQSYRTPLTFGGGTKVEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 342 - protein, 723 aa, Artificial Sequence
  NK77.34_CD70_DB02_H05 construct
MALPVTALLLPLALLLHAARPDYKDDDDKGGGGSGGGGSQVQLVQSGAEVKKPGASVKVSCKASGYTFTDYFTHWVRQAPGQGLEWMGWINTYDGNTNYAQKFQGRVTMTRDTSTSTVYMELSSLRSEDTAVYYCAREMEWLGQVDYWGQGTLVTVSSGGGGSGGGGSGGGGSDIQMTQSPSSLSASVGDRVTITCRASQDIRNDLGWYQQKPGKAPKLLIYAASNLETGVPSRFSGSGSGTDFTLTISSLQPEDFATYYCQQSYSAPFTFGPGTKVDIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 343 - protein, 723 aa, Artificial Sequence
  NK77.35_CD70_DB02_H08 construct
MALPVTALLLPLALLLHAARPDYKDDDDKGGGGSGGGGSQVQLVQSGAEVKKPGASVKVSCKASGYTFTSYYIHWVRQAPGQGLEWMGRINPNGGGTNYAQKFQGRVTMTRDTSTSTVYMELSSLRSEDTAVYYCARGHRGGGGIDYWGQGTLVTVSSGGGGSGGGGSGGGGSDIQMTQSPSSLSASVGDRVTITCRASQEISNYLAWYQQKPGKAPKLLIYDASNLQTGVPSRFSGSGSGTDFTLTISSLQPEDFATYYCQQSYSTPFTFGPGTKVDIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 344 - protein, 723 aa, Artificial Sequence
  NK77.36_CD70_DB03_A06 construct
MALPVTALLLPLALLLHAARPDYKDDDDKGGGGSGGGGSQVQLVQSGAEVKKPGASVKVSCKASGGTFSSYAISWVRQAPGQGLEWMGWISPNSGDTHYAQKFQGRVTMTRDTSTSTVYMELSSLRSEDTAVYYCARDWGSGWYVDYWGQGTLVTVSSGGGGSGGGGSGGGGSDIQMTQSPSSLSASVGDRVTITCQASQDISDSLNWYQQKPGKAPKLLIYSASSLQSGVPSRFSGSGSGTDFTLTISSLQPEDFATYYCQQSFTTPYTFGQGTKVEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 345 - protein, 723 aa, Artificial Sequence
  NK77.37_CD70_DB03_A07 construct
MALPVTALLLPLALLLHAARPDYKDDDDKGGGGSGGGGSQVQLVQSGAEVKKPGSSVKVSCKASGGTFNSYGISWVRQAPGQGLEWMGGIIPIFGTANYAQKFQGRVTITADESTSTAYMELSSLRSEDTAVYYCARDTYGDDAFDIWGQGTMVTVSSGGGGSGGGGSGGGGSDIQMTQSPSSLSASVGDRVTITCRASQSISSWLAWYQQKPGKAPKLLIYDASNLETGVPSRFSGSGSGTDFTLTISSLQPEDFATYYCQQNFSPPLTFGQGTRLEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 346 - protein, 728 aa, Artificial Sequence
  NK77.38_CD70_DB03_A08 construct
MALPVTALLLPLALLLHAARPDYKDDDDKGGGGSGGGGSQVQLVQSGAEVKKPGASVKVSCKASGYSFTSYYMHWVRQAPGQGLEWMGIINPSGGTTSYAQKFQGRVTMTRDTSTSTVYMELSSLRSEDTAVYYCARDNSPYSSSWWDYFDYWGQGTLVTVSSGGGGSGGGGSGGGGSDIQMTQSPSSLSASVGDRVTITCRASQDIRHYLAWYQQKPGKAPKLLIYDASSLQSGVPSRFSGSGSGTDFTLTISSLQPEDFATYYCQQTYDAPITFGQGTRLEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 347 - protein, 726 aa, Artificial Sequence
  NK77.39_CD70_DB03_A09 construct
MALPVTALLLPLALLLHAARPDYKDDDDKGGGGSGGGGSQVQLVQSGAEVKKPGASVKVSCKASGYTFTDYYIHWVRQAPGQGLEWMGWITPNSGYTYYAQNFQGRVTMTRDTSTSTVYMELSSLRSEDTAVYYCARNTDCYGDFLGLDVWGQGTTVTVSSGGGGSGGGGSGGGGSDIVMTQSPDSLAVSLGERATINCRASSSISNYLAWYQQKPGQPPKLLIYGASTRASGVPDRFSGSGSGTDFTLTISSLQAEDVAVYYCQQSYSTPLTFGQGTKVEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 348 - protein, 726 aa, Artificial Sequence
  NK77.40_CD70_DB03_A11 construct
MALPVTALLLPLALLLHAARPDYKDDDDKGGGGSGGGGSQVQLVQSGAEVKKPGASVKVSCKASGYTFNGYLMHWVRQAPGQGLEWMGIVNPSDGSTGYAQKFQGRVTMTRDTSTSTVYMELSSLRSEDTAVYYCAKDTGLRYFDWLLDYWGQGTLVTVSSGGGGSGGGGSGGGGSDIQMTQSPSSLSASVGDRVTITCRASQGITNFLAWYQQKPGKAPKLLIYDASNLETGVPSRFSGSGSGTDFTLTISSLQPEDFATYYCQQSYGAPLTFGQGTRLEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 349 - protein, 722 aa, Artificial Sequence
  NK77.41_CD70_DB03_A12 construct
MALPVTALLLPLALLLHAARPDYKDDDDKGGGGSGGGGSQVQLVQSGAEVKKPGASVKVSCKASGYTFTSYYMHWVRQAPGQGLEWMGIIDPSGGRTIYAQRFQGRVTMTRDTSTSTVYMELSSLRSEDTAVYYCARHEAGGIFDYWGQGTLVTVSSGGGGSGGGGSGGGGSDIQMTQSPSSLSASVGDRVTITCQASQDISNYLNWYQQKPGKAPKLLIYSASTLQSGVPSRFSGSGSGTDFTLTISSLQPEDFATYYCQQSYSSPYRFGQGTKVEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 350 - protein, 730 aa, Artificial Sequence
  NK77.42_CD70_DB03_B01 construct
MALPVTALLLPLALLLHAARPDYKDDDDKGGGGSGGGGSQVQLVQSGAEVKKPGSSVKVSCKASGYTFSDSYMHWVRQAPGQGLEWVGGIIPMAGIPAYAEEFQGRVTITADESTSTAYMELSSLRSEDTAVYYCARADDYGGNWYFDLWGRGTLVTVSSGGGGSGGGGSGGGGSDIVMTQSPLSLPVTPGEPASISCRSSQSLLHSNGYNYLDWYLQKPGQSPQLLIYAASSLQSGVPDRFSGSGSGTDFTLKISRVEAEDVGVYYCMQGAHWPPTFGQGTKLEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 351 - protein, 724 aa, Artificial Sequence
  NK77.43_CD70_DB03_B04 construct
MALPVTALLLPLALLLHAARPDYKDDDDKGGGGSGGGGSQVQLVQSGAEVKKPGASVKVSCKASGYIFTDYYMHWVRQAPGQGLEWMGIINPSGGSTSYAQKFQGRVTMTRDTSTSTVYMELSSLRSEDTAVYYCARDSGWYESWFDPWGQGTLVTVSSGGGGSGGGGSGGGGSDIQMTQSPSSLSASVGDRVTITCRASQDIRDGLGWYQQKPGKAPKLLIYAASTLQSGVPSRFSGSGSGTDFTLTISSLQPEDFATYYCQQSYGTPPTFGQGTKVEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 352 - protein, 725 aa, Artificial Sequence
  NK77.44_CD70_DB03_B06 construct
MALPVTALLLPLALLLHAARPDYKDDDDKGGGGSGGGGSQVQLVQSGAEVKKPGASVKVSCKASGYTFTDYYLHWVRQAPGQGLEWMGWISAYNGNTNYAQKFQGRVTMTRDTSTSTVYMELSSLRSEDTAVYYCAREIVGATEDWYFDLWGRGTLVTVSSGGGGSGGGGSGGGGSEIVMTQSPATLSVSPGERATLSCRASQSVSSYLAWYQQKPGQAPRLLIYGASTRATGIPARFSGSGSGTEFTLTISSLQSEDFAVYYCQQYDSSPTFGQGTKVEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 353 - protein, 723 aa, Artificial Sequence
  NK77.45_CD70_DB03_B09 construct
MALPVTALLLPLALLLHAARPDYKDDDDKGGGGSGGGGSQVQLVQSGAEVKKPGASVKVSCKASGYTFTAYYLHWVRQAPGQGLEWMGMINPNNGGTIYAQTFQGRVTMTRDTSTSTVYMELSSLRSEDTAVYYCARDLGGYVLFDYWGQGTLVTVSSGGGGSGGGGSGGGGSDIQMTQSPSSLSASVGDRVTITCRASQSISSYLNWYQQKPGKAPKLLIYDASNLETGVPSRFSGSGSGTDFTLTISSLQPEDFATYYCQQSHSAPITFGQGTRLEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 354 - protein, 723 aa, Artificial Sequence
  NK77.46_CD70_DB03_C05 construct
MALPVTALLLPLALLLHAARPDYKDDDDKGGGGSGGGGSQVQLVQSGAEVKKPGASVKVSCKASGYTFTDYYIHWVRQAPGQGLEWMGMINPRGGSTTYAQSFQGRVTMTRDTSTSTVYMELSSLRSEDTAVYYCARDLGDYGDYDYWGQGTLVTVSSGGGGSGGGGSGGGGSDIQMTQSPSSLSASVGDRVTITCRASQSISTNLAWYQQKPGKAPKLLIYDASYLEAGVPSRFSGSGSGTDFTLTISSLQPEDFATYYCQQSYSTPPTFGQGTKLEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 355 - protein, 734 aa, Artificial Sequence
  NK77.47_CD70_DB03_D11 construct
MALPVTALLLPLALLLHAARPDYKDDDDKGGGGSGGGGSEVQLLESGGGLVQPGGSLRLSCAASGFTFSNSDMNWVRQAPGKGLEWVSAISGGGDTLYYADSVKGRFTISRDNSKNTLYLQMNSLRAEDTAVYYCAMASALDSSGDNEAFDIWGQGTTVTVSSGGGGSGGGGSGGGGSDIVMTQSPDSLAVSLGERATINCKSSQSVLYSSNNKNYLAWYQQKPGQPPKLLIYWASTRDSGVPDRFSGSGSGTDFTLTISSLQAEDVAVYYCQQYYGFPPTFGQGTRLEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 356 - protein, 726 aa, Artificial Sequence
  NK77.48_CD70_DB03_E01 construct
MALPVTALLLPLALLLHAARPDYKDDDDKGGGGSGGGGSQVQLVQSGAEVKKPGASVKVSCKASGYTFTSYYMHWVRQAPGQGLEWMGWINPNNGGTSYAQKFQGRVTMTRDTSTSTVYMELSSLRSEDTAVYYCARVEDDFWSGPSFDYWGQGTLVTVSSGGGGSGGGGSGGGGSDIQMTQSPSSLSASVGDRVTITCQASHDISKFLNWYQQKPGKAPKLLIYDASNLQRGVPSRFSGSGSGTDFTLTISSLQPEDFATYYCQQTYSFPFTFGQGTKLEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 357 - protein, 728 aa, Artificial Sequence
  NK77.49_CD70_DB03_E03 construct
MALPVTALLLPLALLLHAARPDYKDDDDKGGGGSGGGGSQVQLVQSGAEVKKPGSSVKVSCKASGGTFTNYAFSWVRQAPGQGLEWMGGIIPISGAANYAQKFQGRVTITADESTSTAYMELSSLRSEDTAVYYCARGSGLDDAFDIWGQGTMVTVSSGGGGSGGGGSGGGGSDIVMTQSPLSLPVTPGEPASISCRSSQSLLHSNGYNYLDWYLQKPGQSPQLLIYDASSLQSGVPDRFSGSGSGTDFTLKISRVEAEDVGVYYCMQARQTPLTFGQGTRLEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 358 - protein, 738 aa, Artificial Sequence
  NK77.50_CD70_DB03_E09 construct
MALPVTALLLPLALLLHAARPDYKDDDDKGGGGSGGGGSQVQLVQSGAEVKKPGASVKVSCKASGYTFTAYYMHWVRQAPGQGLEWMGWMNPNSGNTGYAQKFQGRVTMTRDTSTSTVYMELSSLRSEDTAVYYCAREGRIDYGDYDDYYYYYGMDVWGQGTTVTVSSGGGGSGGGGSGGGGSDIVMTQSPLSLPVTPGEPASISCRSSQSLLHSNGYNYLDWYLQKPGQSPQLLIYAASNLQGGVPDRFSGSGSGTDFTLKISRVEAEDVGVYYCMQTLESPVTFGGGTKVEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 359 - protein, 724 aa, Artificial Sequence
  NK77.51_CD70_DB03_F02 construct
MALPVTALLLPLALLLHAARPDYKDDDDKGGGGSGGGGSQVQLVQSGAEVKKPGASVKVSCKASGYTFTDYYVHWVRQAPGQGLEWMGTINPSGGSTSYAQKFQGRVTMTRDTSTSTVYMELSSLRSEDTAVYYCARDQGLWFTGFDYWGQGTLVTVSSGGGGSGGGGSGGGGSDIQMTQSPSSLSASVGDRVTITCRASQGISNNLNWYQQKPGKAPKLLIYDASNLERGVPSRFSGSGSGTDFTLTISSLQPEDFATYYCQQSYDGPITFGQGTRLEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 360 - protein, 724 aa, Artificial Sequence
  NK77.52_CD70_DB03_F05 construct
MALPVTALLLPLALLLHAARPDYKDDDDKGGGGSGGGGSQVQLVQSGAEVKKPGASVKVSCKASGYTFTAYHMHWVRQAPGQGLEWMGIINPGDGATGYAQNLQGRVTMTRDTSTSTVYMELSSLRSEDTAVYYCAGEGISGSDAFDIWGQGTLVTVSSGGGGSGGGGSGGGGSDIQMTQSPSSLSASVGDRVTITCRASQSISSWLAWYQQKPGKAPKLLIYAASSLQSGVPSRFSGSGSGTDFTLTISSLQPEDFATYYCLQDYSYPLTFGGGTKVEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 361 - protein, 722 aa, Artificial Sequence
  NK77.53_CD70_DB03_F06 construct
MALPVTALLLPLALLLHAARPDYKDDDDKGGGGSGGGGSQVQLVQSGAEVKKPGSSVKVSCKASGGTFSSYAISWVRQAPGQGLEWMGWMNPNSGNTGYAQKFQGRVTITADESTSTAYMELSSLRSEDTAVYYCAWGVDPYYFDYWGQGTLVTVSSGGGGSGGGGSGGGGSDIQMTQSPSSLSASVGDRVTITCRASQSINRWLAWYQQKPGKAPKLLIYDASNLETGVPSRFSGSGSGTDFTLTISSLQPEDFATYYCQQSYITPLTFGGGTKVEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 362 - protein, 722 aa, Artificial Sequence
  NK77.54_CD70_DB03_F09 construct
MALPVTALLLPLALLLHAARPDYKDDDDKGGGGSGGGGSQVQLVQSGAEVKKPGASVKVSCKASGYTFTSYYMHWVRQAPGQGLEWMGIFNPSDGSTSYAQKFQGRVTMTRDTSTSTVYMELSSLRSEDTAVYYCARDVGETTFDPWGQGTLVTVSSGGGGSGGGGSGGGGSDIQMTQSPSSLSASVGDRVTITCQASQDISNYLNWYQQKPGKAPKLLIYDASSLESGVPSRFSGSGSGTDFTLTISSLQPEDFATYYCQQTNSFPITFGQGTRLEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 363 - protein, 727 aa, Artificial Sequence
  NK77.55_CD70_DB03_F12 construct
MALPVTALLLPLALLLHAARPDYKDDDDKGGGGSGGGGSQVQLVQSGAEVKKPGASVKVSCKASGYTFTSYGISWVRQAPGQGLEWMGWISAYNGHTNYAQKFQGRVTMTRDTSTSTVYMELSSLRSEDTAVYYCARDSVRGWDYYYGMGVWGQGTTVTVSSGGGGSGGGGSGGGGSDIQMTQSPSSLSASVGDRVTITCQASQDIRNFLNWYQQKPGKAPKLLIYAASTLQSGVPSRFSGSGSGTDFTLTISSLQPEDFATYYCQQSYSAPSTFGQGTKLEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 364 - protein, 724 aa, Artificial Sequence
  NK77.56_CD70_DB03_G06 construct
MALPVTALLLPLALLLHAARPDYKDDDDKGGGGSGGGGSQVQLVQSGAEVKKPGSSVKVSCKASGYTFIDYYMHWVRQAPGQGLEWMGWMNPHSGNSDNAPKFQGRVTITADESTSTAYMELSSLRSEDTAVYYCARGYSGYDLTADYWGQGTLVTVSSGGGGSGGGGSGGGGSDIQMTQSPSSLSASVGDRVTITCRASQSISNYLNWYQQKPGKAPKLLIYDASNLETGVPSRFSGSGSGTDFTLTISSLQPEDFATYYCQQSYSTPITFGQGTRLEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 365 - protein, 733 aa, Artificial Sequence
  NK77.57_CD70_DB03_G11 construct
MALPVTALLLPLALLLHAARPDYKDDDDKGGGGSGGGGSQVQLVQSGAEVKKPGASVKVSCKASGYTFTGQYMHWVRQAPGQGLEWMGWINPNTGDTNYAQKFQGRVTMTRDTSTSTVYMELSSLRSEDTAVYYCARDSVFEVEGGTDYYYYYGMDVWGQGTMVTVSSGGGGSGGGGSGGGGSDIQMTQSPSSLSASVGDRVTITCRASETISGWLAWYQQKPGKAPKLLIYDASNLETGVPSRFSGSGSGTDFTLTISSLQPEDFATYYCQQSYSTPWTFGQGTKLEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 366 - protein, 723 aa, Artificial Sequence
  NK77.58_CD70_DB03_H08 construct
MALPVTALLLPLALLLHAARPDYKDDDDKGGGGSGGGGSQVQLVQSGAEVKKPGASVKVSCKASGYTFTSYDINWVRQAPGQGLEWMGVINPSGGGTSYAQKFQGRVTMTRDTSTSTVYMELSSLRSEDTAVYYCARYSGYDWVFDYWGQGTLVTVSSGGGGSGGGGSGGGGSDIQMTQSPSSLSASVGDRVTITCRASQGIGSWLAWYQQKPGKAPKLLIYAASTLQSGVPSRFSGSGSGTDFTLTISSLQPEDFATYYCQQSYSTPWTFGPGTKVDIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 367 - protein, 724 aa, Artificial Sequence
  NK77.59_CD70_DB03_H10 construct
MALPVTALLLPLALLLHAARPDYKDDDDKGGGGSGGGGSQVQLVQSGAEVKKPGASVKVSCKASGYTFANYYMHWVRQAPGQGLEWMGIINPSGGSTSYAQKFQGRVTMTRDTSTSTVYMELSSLRSEDTAVYYCARDSGSYFGWFDPWGQGTLVTVSSGGGGSGGGGSGGGGSDIQMTQSPSSLSASVGDRVTITCRASQSISSSLAWYQQKPGKAPKLLIYDASSLQSGVPSRFSGSGSGTDFTLTISSLQPEDFATYYCQQSYNTPPTFGGGTKLEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 368 - protein, 724 aa, Artificial Sequence
  NK77.60_CD70_DB04_A05 construct
MALPVTALLLPLALLLHAARPDYKDDDDKGGGGSGGGGSQVQLVQSGAEVKKPGASVKVSCKASGYTFTTYYMHWVRQAPGQGLEWMGIINPTGGSTYYAQKFQGRVTMTRDTSTSTVYMELSSLRSEDTAVYYCARDSGNYQGIFDYWGQGTLVTVSSGGGGSGGGGSGGGGSDIQMTQSPSSLSASVGDRVTITCRASQGIGGYLAWYQQKPGKAPKLLIYDASNLETGVPSRFSGSGSGTDFTLTISSLQPEDFATYYCQQSYDSPPTFGQGTRLEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 369 - protein, 723 aa, Artificial Sequence
  NK77.61_CD70_DB04_A07 construct
MALPVTALLLPLALLLHAARPDYKDDDDKGGGGSGGGGSQVQLVQSGAEVKKPGASVKVSCKASGNTFTSYYMHWVRQAPGQGLEWMGWINPNSGDTNYAQNFQGRVTMTRDTSTSTVYMELSSLRSEDTAVYYCARGVSGYDLFDYWGQGTLVTVSSGGGGSGGGGSGGGGSDIQMTQSPSSLSASVGDRVTITCRASQSVSSYLNWYQQKPGKAPKLLIYDTSNLETGVPSRFSGSGSGTDFTLTISSLQPEDFATYYCQQAHSFPLTFGGGTKVEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 370 - protein, 723 aa, Artificial Sequence
  NK77.62_CD70_DB04_A10 construct
MALPVTALLLPLALLLHAARPDYKDDDDKGGGGSGGGGSEVQLVESGGGLVKPGGSLRLSCAASGFTFSSYGMHWVRQAPGKGLEWVASIKHDGSEQYYVDSVKGRFTISRDDSKNTLYLQMNSLKTEDTAVYYCAASGVDVWGQGTTVTVSSGGGGSGGGGSGGGGSDIVMTQSPLSLPVTPGEPASISCRSSQSLLHSNGYNYLDWYLQKPGQSPQLLIYLGSTRASGVPDRFSGSGSGTDFTLKISRVEAEDVGVYYCMQALDTPLTFGGGTKLEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 371 - protein, 726 aa, Artificial Sequence
  NK77.63_CD70_DB04_A11 construct
MALPVTALLLPLALLLHAARPDYKDDDDKGGGGSGGGGSQVQLVQSGAEVKKPGASVKVSCKASGGTFSRYDINWVRQAPGQGLEWVGIIDPTGASTSYAQKFQGRVTMTRDTSTSTVYMELSSLRSEDTAVYYCARDYSYGMDYYGMDVWGQGTLVTVSSGGGGSGGGGSGGGGSDIQMTQSPSSLSASVGDRVTITCQASQDISNYLNWYQQKPGKAPKLLIYDTSNLQTGVPSRFSGSGSGTDFTLTISSLQPEDFATYYLSTDLQTTAHFGQGTKVEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 372 - protein, 728 aa, Artificial Sequence
  NK77.64_CD70_DB04_B03 construct
MALPVTALLLPLALLLHAARPDYKDDDDKGGGGSGGGGSQVQLVQSGAEVKKPGSSVKVSCKASGYTFTSYGISWVRQAPGQGLEWMGGIIPIFGTTNYAQKFQGRVTITADESTSTAYMELSSLRSEDTAVYYCARDHSGDGYFDLWGRGTLVTVSSGGGGSGGGGSGGGGSDIVMTQSPLSLPVTPGEPASISCRSSQSLLHSNGYNYLDWYLQKPGQSPQLLIYDASSLQSGVPDRFSGSGSGTDFTLKISRVEAEDVGVYYCMQGTHWPPTFGQGTKVEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 373 - protein, 722 aa, Artificial Sequence
  NK77.65_CD70_DB04_B05 construct
MALPVTALLLPLALLLHAARPDYKDDDDKGGGGSGGGGSQVQLVQSGAEVKKPGASVKVSCKASGYTFTENEMHWVRQAPGQGLEWMGWINPNSGGTNYAQKFQGRVTMTRDTSTSTVYMELSSLRSEDTAVYYCAGSWGGYYFDYWGQGTLVTVSSGGGGSGGGGSGGGGSDIQMTQSPSSLSASVGDRVTITCRASQSVSRYLNWYQQKPGKAPKLLIYDASNLETGVPSRFSGSGSGTDFTLTISSLQPEDFATYYCQQADSFPVTFGQGTKLEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 374 - protein, 725 aa, Artificial Sequence
  NK77.66_CD70_DB04_B07 construct
MALPVTALLLPLALLLHAARPDYKDDDDKGGGGSGGGGSQVQLVQSGAEVKKPGASVKVSCKASGYTFTNYYIYWVRQAPGQGLEWMGWINPNDGATNYAQKFQGRVTMTRDTSTSTVYMELSSLRSEDTAVYYCAREGNDYYYYFMDYWGQGTLVTVSSGGGGSGGGGSGGGGSDIQMTQSPSSLSASVGDRVTITCRASQGISNNLNWYQQKPGKAPKLLIYHASNLETGVPSRFSGSGSGTDFTLTISSLQPEDFATYYCQQSYDGPMTFGQGTKLEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 375 - protein, 731 aa, Artificial Sequence
  NK77.67_CD70_DB04_C01 construct
MALPVTALLLPLALLLHAARPDYKDDDDKGGGGSGGGGSQVQLVQSGAEVKKPGSSVKVSCKASGGTFSSYAISWVRQAPGQGLEWMGGITPMFGTTDYAQKFQGRVTITADESTSTAYMELSSLRSEDTAVYYCARDERDGYATVAFDIWGQGTMVTVSSGGGGSGGGGSGGGGSDIVMTQSPLSLPVTPGEPASISCRSSQSLLHSNGYNYLDWYLQKPGQSPQLLIYDASNLETGVPDRFSGSGSGTDFTLKISRVEAEDVGVYYCMQGTHWPPTFGQGTKVEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 376 - protein, 726 aa, Artificial Sequence
  NK77.68_CD70_DB04_C04 construct
MALPVTALLLPLALLLHAARPDYKDDDDKGGGGSGGGGSQVQLVQSGAEVKKPGASVKVSCKASGYTFTSYYMHWVRQAPGQGLEWMGIINPSDGGTSYADKFQGRVTMTRDTSTSTVYMELSSLRSEDTAVYYCARALAPLGWGDGMDVWGQGTTVTVSSGGGGSGGGGSGGGGSDIQMTQSPSSLSASVGDRVTITCQASQDISNYLNWYQQKPGKAPKLLIYDASNLETGVPSRFSGSGSGTDFTLTISSLQPEDFATYYCQQSYDGPITFGQGTRLEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 377 - protein, 723 aa, Artificial Sequence
  NK77.69_CD70_DB04_C06 construct
MALPVTALLLPLALLLHAARPDYKDDDDKGGGGSGGGGSQVQLVQSGAEVKKPGSSVKVSCKASGYTFTSYYIHWVRQAPGQGLEWMGWMNPSSGVTNFAQKFQGRVTITADESTSTAYMELSSLRSEDTAVYYCARGSDQGDWSDPWGQGTLVTVSSGGGGSGGGGSGGGGSDIQMTQSPSSLSASVGDRVTITCRASQSISSYLNWYQQKPGKAPKLLIYDASNLETGVPSRFSGSGSGTDFTLTISSLQPEDFATYYCQQSYNTPPTFGGGTKVEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 378 - protein, 726 aa, Artificial Sequence
  NK77.70_CD70_DB04_C07 construct
MALPVTALLLPLALLLHAARPDYKDDDDKGGGGSGGGGSQVQLVQSGAEVKKPGASVKVSCKASGYTFTDSYIHWVRQAPGQGLEWIGWMNPNTGDTGYAQKFQGRVTMTRDTSTSTVYMELSSLRSEDTAVYYCAKDDFGELAPATFDPWGQGTLVTVSSGGGGSGGGGSGGGGSDIQMTQSPSSLSASVGDRVTITCQASQDISNYLNWYQQKPGKAPKLLIYGASSLQSGVPSRFSGSGSGTDFTLTISSLQPEDFATYYCLQDAATPITFGQGTRLEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 379 - protein, 726 aa, Artificial Sequence
  NK77.71_CD70_DB04_D02 construct
MALPVTALLLPLALLLHAARPDYKDDDDKGGGGSGGGGSQVQLVQSGAEVKKPGASVKVSCKASGYTFTSYDINWVRQAPGQGLEWMGVISPSGGGTSYAQKFQGRVTMTRDTSTSTVYMELSSLRSEDTAVYYCARYYGGNPEGWYFDLWGRGTLVTVSSGGGGSGGGGSGGGGSDIQMTQSPSSLSASVGDRVTITCRASQSIGNWLAWYQQKPGKAPKLLIYDASDLETGVPSRFSGSGSGTDFTLTISSLQPEDFATYYCQQSYTTPWTFGQGTKVEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 380 - protein, 741 aa, Artificial Sequence
  NK77.72_CD70_DB04_D05 construct
MALPVTALLLPLALLLHAARPDYKDDDDKGGGGSGGGGSEVQLLESGGGLVQPGGSLRLSCAASGFVFDDYAIHWVRQAPGKGLEWVAAISYDGSNKYYADSVKGRFTISRDNSKNTLYLQMNSLRAEDTAVYYCARAPQYYGSGTDPLEVRYYYYGMDVWGQGTTVTVSSGGGGSGGGGSGGGGSDIVMTQSPLSLPVTPGEPASISCRSSQSLLHSNGYNYLDWYLQKPGQSPQLLIYEVSNRASGVPDRFSGSGSGTDFTLKISRVEAEDVGVYYCMKGLQTPLTFGPGTKVDIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 381 - protein, 726 aa, Artificial Sequence
  NK77.73_CD70_DB04_D07 construct
MALPVTALLLPLALLLHAARPDYKDDDDKGGGGSGGGGSQVQLVQSGAEVKKPGSSVKVSCKASGGTFRNYAISWVRQAPGQGLEWMGGIIPIFGTANYAQKFQGRVTITADESTSTAYMELSSLRSEDTAVYYCARDHSAGTHHDAFDIWGQGTMVTVSSGGGGSGGGGSGGGGSDIQMTQSPSSLSASVGDRVTITCRASQGISNYLAWYQQKPGKAPKLLIYAASSLQSGVPSRFSGSGSGTDFTLTISSLQPEDFATYYCQQSHSTPLTFGQGTKVEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 382 - protein, 721 aa, Artificial Sequence
  NK77.74_CD70_DB04_D08 construct
MALPVTALLLPLALLLHAARPDYKDDDDKGGGGSGGGGSQVQLVQSGAEVKKPGASVKVSCKASGYTFTSYYIHWVRQAPGQGLEWMGWMNPNSGNAGYAQKFQGRVTMTRDTSTSTVYMELSSLRSEDTAVYYCAREYWGSFDYWGQGTLVTVSSGGGGSGGGGSGGGGSDIQMTQSPSSLSASVGDRVTITCRASQGISNNLNWYQQKPGKAPKLLIYDASNLETGVPSRFSGSGSGTDFTLTISSLQPEDFATYYCQQSYSTPYTFGQGTKVEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 383 - protein, 722 aa, Artificial Sequence
  NK77.75_CD70_DB04_D10 construct
MALPVTALLLPLALLLHAARPDYKDDDDKGGGGSGGGGSQVQLVQSGAEVKKPGASVKVSCKASGYTFTGYYMHWVRQAPGQGLEWMGMIDPSDGSTIYAQKFQGRVTMTRDTSTSTVYMELSSLRSEDTAVYYCARERPLYASDLWGQGTLVTVSSGGGGSGGGGSGGGGSDIQMTQSPSSLSASVGDRVTITCRASQDIGNDLGWYQQKPGKAPKLLIYAASSLQSGVPSRFSGSGSGTDFTLTISSLQPEDFATYYCLQDYDYPLTFGQGTKVEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 384 - protein, 723 aa, Artificial Sequence
  NK77.85_CD70_DB03_B02 construct
MALPVTALLLPLALLLHAARPDYKDDDDKGGGGSGGGGSQVQLVQSGAEVKKPGSSVKVSCKASGYTFTNYYMHWVRQAPGQGLEWMGWMNPDSGNTGYAQKFQGRVTITADESTSTAYMELSSLRSEDTAVYYCARSSSSWPDFDLWGRGTLVTVSSGGGGSGGGGSGGGGSDIQMTQSPSSLSASVGDRVTITCRASQSISSYLNWYQQKPGKAPKLLIYDASNLETGVPSRFSGSGSGTDFTLTISSLQPEDFATYYCQQSYNTPYSFGQGTKVEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 385 - protein, 724 aa, Artificial Sequence
  NK77.86_CD70_DB04_A06 construct
MALPVTALLLPLALLLHAARPDYKDDDDKGGGGSGGGGSQVQLVQSGAEVKKPGASVKVSCKASGYTFTSYSMHWVRQAPGQGLEWVGIINPSSGSASYAQKFQGRVTMTRDTSTSTVYMELSSLRSEDTAVYYCARERGAYSSTFDYWGQGTLVTVSSGGGGSGGGGSGGGGSDIQMTQSPSSLSASVGDRVTITCRTSQSISSYLNWYQQKPGKAPKLLIYDASNLETGVPSRFSGSGSGTDFTLTISSLQPEDFATYYCLQDYSYPLTFGQGTKVEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 386 - protein, 724 aa, Artificial Sequence
  NK77.87_CD70_DB04_A09 construct
MALPVTALLLPLALLLHAARPDYKDDDDKGGGGSGGGGSQVQLVQSGAEVKKPGASVKVSCKASGYTFTDYYMHWVRQAPGQGLEWMGVINPSDGTAHYAQRLQGRVTMTRDTSTSTVYMELSSLRSEDTAVYYCARDSGSYYADFDYWGQGTLVTVSSGGGGSGGGGSGGGGSDIQMTQSPSSLSASVGDRVTITCQASQDISNYLNWYQQKPGKAPKLLIYDASSLQSGVPSRFSGSGSGTDFTLTISSLQPEDFATYYCQQSYSTPPAFGQGTKVEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 387 - protein, 989 aa, Artificial Sequence
  NK77.76_38-38 construct
MALPVTALLLPLALLLHAARPDYKDDDDKGGGGSGGGGSQVQLVQSGAEVKKPGASVKVSCKASGYSFTSYYMHWVRQAPGQGLEWMGIINPSGGTTSYAQKFQGRVTMTRDTSTSTVYMELSSLRSEDTAVYYCARDNSPYSSSWWDYFDYWGQGTLVTVSSGGGGSGGGGSGGGGSDIQMTQSPSSLSASVGDRVTITCRASQDIRHYLAWYQQKPGKAPKLLIYDASSLQSGVPSRFSGSGSGTDFTLTISSLQPEDFATYYCQQTYDAPITFGQGTRLEIKGGGGSGGGGSGGGGSQVQLVQSGAEVKKPGASVKVSCKASGYSFTSYYMHWVRQAPGQGLEWMGIINPSGGTTSYAQKFQGRVTMTRDTSTSTVYMELSSLRSEDTAVYYCARDNSPYSSSWWDYFDYWGQGTLVTVSSGGGGSGGGGSGGGGSDIQMTQSPSSLSASVGDRVTITCRASQDIRHYLAWYQQKPGKAPKLLIYDASSLQSGVPSRFSGSGSGTDFTLTISSLQPEDFATYYCQQTYDAPITFGQGTRLEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 388 - protein, 989 aa, Artificial Sequence
  NK77.77_64-64 construct
MALPVTALLLPLALLLHAARPDYKDDDDKGGGGSGGGGSQVQLVQSGAEVKKPGSSVKVSCKASGYTFTSYGISWVRQAPGQGLEWMGGIIPIFGTTNYAQKFQGRVTITADESTSTAYMELSSLRSEDTAVYYCARDHSGDGYFDLWGRGTLVTVSSGGGGSGGGGSGGGGSDIVMTQSPLSLPVTPGEPASISCRSSQSLLHSNGYNYLDWYLQKPGQSPQLLIYDASSLQSGVPDRFSGSGSGTDFTLKISRVEAEDVGVYYCMQGTHWPPTFGQGTKVEIKGGGGSGGGGSGGGGSQVQLVQSGAEVKKPGSSVKVSCKASGYTFTSYGISWVRQAPGQGLEWMGGIIPIFGTTNYAQKFQGRVTITADESTSTAYMELSSLRSEDTAVYYCARDHSGDGYFDLWGRGTLVTVSSGGGGSGGGGSGGGGSDIVMTQSPLSLPVTPGEPASISCRSSQSLLHSNGYNYLDWYLQKPGQSPQLLIYDASSLQSGVPDRFSGSGSGTDFTLKISRVEAEDVGVYYCMQGTHWPPTFGQGTKVEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 389 - protein, 977 aa, Artificial Sequence
  NK77.78_65-65 construct
MALPVTALLLPLALLLHAARPDYKDDDDKGGGGSGGGGSQVQLVQSGAEVKKPGASVKVSCKASGYTFTENEMHWVRQAPGQGLEWMGWINPNSGGTNYAQKFQGRVTMTRDTSTSTVYMELSSLRSEDTAVYYCAGSWGGYYFDYWGQGTLVTVSSGGGGSGGGGSGGGGSDIQMTQSPSSLSASVGDRVTITCRASQSVSRYLNWYQQKPGKAPKLLIYDASNLETGVPSRFSGSGSGTDFTLTISSLQPEDFATYYCQQADSFPVTFGQGTKLEIKGGGGSGGGGSGGGGSQVQLVQSGAEVKKPGASVKVSCKASGYTFTENEMHWVRQAPGQGLEWMGWINPNSGGTNYAQKFQGRVTMTRDTSTSTVYMELSSLRSEDTAVYYCAGSWGGYYFDYWGQGTLVTVSSGGGGSGGGGSGGGGSDIQMTQSPSSLSASVGDRVTITCRASQSVSRYLNWYQQKPGKAPKLLIYDASNLETGVPSRFSGSGSGTDFTLTISSLQPEDFATYYCQQADSFPVTFGQGTKLEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 390 - protein, 992 aa, Artificial Sequence
  NK77.79_38-67 construct
MALPVTALLLPLALLLHAARPDYKDDDDKGGGGSGGGGSQVQLVQSGAEVKKPGASVKVSCKASGYSFTSYYMHWVRQAPGQGLEWMGIINPSGGTTSYAQKFQGRVTMTRDTSTSTVYMELSSLRSEDTAVYYCARDNSPYSSSWWDYFDYWGQGTLVTVSSGGGGSGGGGSGGGGSDIQMTQSPSSLSASVGDRVTITCRASQDIRHYLAWYQQKPGKAPKLLIYDASSLQSGVPSRFSGSGSGTDFTLTISSLQPEDFATYYCQQTYDAPITFGQGTRLEIKGGGGSGGGGSGGGGSQVQLVQSGAEVKKPGSSVKVSCKASGGTFSSYAISWVRQAPGQGLEWMGGITPMFGTTDYAQKFQGRVTITADESTSTAYMELSSLRSEDTAVYYCARDERDGYATVAFDIWGQGTMVTVSSGGGGSGGGGSGGGGSDIVMTQSPLSLPVTPGEPASISCRSSQSLLHSNGYNYLDWYLQKPGQSPQLLIYDASNLETGVPDRFSGSGSGTDFTLKISRVEAEDVGVYYCMQGTHWPPTFGQGTKVEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 391 - protein, 987 aa, Artificial Sequence
  NK77.80_38-68 construct
MALPVTALLLPLALLLHAARPDYKDDDDKGGGGSGGGGSQVQLVQSGAEVKKPGASVKVSCKASGYSFTSYYMHWVRQAPGQGLEWMGIINPSGGTTSYAQKFQGRVTMTRDTSTSTVYMELSSLRSEDTAVYYCARDNSPYSSSWWDYFDYWGQGTLVTVSSGGGGSGGGGSGGGGSDIQMTQSPSSLSASVGDRVTITCRASQDIRHYLAWYQQKPGKAPKLLIYDASSLQSGVPSRFSGSGSGTDFTLTISSLQPEDFATYYCQQTYDAPITFGQGTRLEIKGGGGSGGGGSGGGGSQVQLVQSGAEVKKPGASVKVSCKASGYTFTSYYMHWVRQAPGQGLEWMGIINPSDGGTSYADKFQGRVTMTRDTSTSTVYMELSSLRSEDTAVYYCARALAPLGWGDGMDVWGQGTTVTVSSGGGGSGGGGSGGGGSDIQMTQSPSSLSASVGDRVTITCQASQDISNYLNWYQQKPGKAPKLLIYDASNLETGVPSRFSGSGSGTDFTLTISSLQPEDFATYYCQQSYDGPITFGQGTRLEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 392 - protein, 992 aa, Artificial Sequence
  NK77.81_64-67 construct
MALPVTALLLPLALLLHAARPDYKDDDDKGGGGSGGGGSQVQLVQSGAEVKKPGSSVKVSCKASGYTFTSYGISWVRQAPGQGLEWMGGIIPIFGTTNYAQKFQGRVTITADESTSTAYMELSSLRSEDTAVYYCARDHSGDGYFDLWGRGTLVTVSSGGGGSGGGGSGGGGSDIVMTQSPLSLPVTPGEPASISCRSSQSLLHSNGYNYLDWYLQKPGQSPQLLIYDASSLQSGVPDRFSGSGSGTDFTLKISRVEAEDVGVYYCMQGTHWPPTFGQGTKVEIKGGGGSGGGGSGGGGSQVQLVQSGAEVKKPGSSVKVSCKASGGTFSSYAISWVRQAPGQGLEWMGGITPMFGTTDYAQKFQGRVTITADESTSTAYMELSSLRSEDTAVYYCARDERDGYATVAFDIWGQGTMVTVSSGGGGSGGGGSGGGGSDIVMTQSPLSLPVTPGEPASISCRSSQSLLHSNGYNYLDWYLQKPGQSPQLLIYDASNLETGVPDRFSGSGSGTDFTLKISRVEAEDVGVYYCMQGTHWPPTFGQGTKVEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 393 - protein, 987 aa, Artificial Sequence
  NK77.82_64-68 construct
MALPVTALLLPLALLLHAARPDYKDDDDKGGGGSGGGGSQVQLVQSGAEVKKPGSSVKVSCKASGYTFTSYGISWVRQAPGQGLEWMGGIIPIFGTTNYAQKFQGRVTITADESTSTAYMELSSLRSEDTAVYYCARDHSGDGYFDLWGRGTLVTVSSGGGGSGGGGSGGGGSDIVMTQSPLSLPVTPGEPASISCRSSQSLLHSNGYNYLDWYLQKPGQSPQLLIYDASSLQSGVPDRFSGSGSGTDFTLKISRVEAEDVGVYYCMQGTHWPPTFGQGTKVEIKGGGGSGGGGSGGGGSQVQLVQSGAEVKKPGASVKVSCKASGYTFTSYYMHWVRQAPGQGLEWMGIINPSDGGTSYADKFQGRVTMTRDTSTSTVYMELSSLRSEDTAVYYCARALAPLGWGDGMDVWGQGTTVTVSSGGGGSGGGGSGGGGSDIQMTQSPSSLSASVGDRVTITCQASQDISNYLNWYQQKPGKAPKLLIYDASNLETGVPSRFSGSGSGTDFTLTISSLQPEDFATYYCQQSYDGPITFGQGTRLEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 394 - protein, 986 aa, Artificial Sequence
  NK77.83_65-67 construct
MALPVTALLLPLALLLHAARPDYKDDDDKGGGGSGGGGSQVQLVQSGAEVKKPGASVKVSCKASGYTFTENEMHWVRQAPGQGLEWMGWINPNSGGTNYAQKFQGRVTMTRDTSTSTVYMELSSLRSEDTAVYYCAGSWGGYYFDYWGQGTLVTVSSGGGGSGGGGSGGGGSDIQMTQSPSSLSASVGDRVTITCRASQSVSRYLNWYQQKPGKAPKLLIYDASNLETGVPSRFSGSGSGTDFTLTISSLQPEDFATYYCQQADSFPVTFGQGTKLEIKGGGGSGGGGSGGGGSQVQLVQSGAEVKKPGSSVKVSCKASGGTFSSYAISWVRQAPGQGLEWMGGITPMFGTTDYAQKFQGRVTITADESTSTAYMELSSLRSEDTAVYYCARDERDGYATVAFDIWGQGTMVTVSSGGGGSGGGGSGGGGSDIVMTQSPLSLPVTPGEPASISCRSSQSLLHSNGYNYLDWYLQKPGQSPQLLIYDASNLETGVPDRFSGSGSGTDFTLKISRVEAEDVGVYYCMQGTHWPPTFGQGTKVEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 395 - protein, 981 aa, Artificial Sequence
  NK77.84_65-68 construct
MALPVTALLLPLALLLHAARPDYKDDDDKGGGGSGGGGSQVQLVQSGAEVKKPGASVKVSCKASGYTFTENEMHWVRQAPGQGLEWMGWINPNSGGTNYAQKFQGRVTMTRDTSTSTVYMELSSLRSEDTAVYYCAGSWGGYYFDYWGQGTLVTVSSGGGGSGGGGSGGGGSDIQMTQSPSSLSASVGDRVTITCRASQSVSRYLNWYQQKPGKAPKLLIYDASNLETGVPSRFSGSGSGTDFTLTISSLQPEDFATYYCQQADSFPVTFGQGTKLEIKGGGGSGGGGSGGGGSQVQLVQSGAEVKKPGASVKVSCKASGYTFTSYYMHWVRQAPGQGLEWMGIINPSDGGTSYADKFQGRVTMTRDTSTSTVYMELSSLRSEDTAVYYCARALAPLGWGDGMDVWGQGTTVTVSSGGGGSGGGGSGGGGSDIQMTQSPSSLSASVGDRVTITCQASQDISNYLNWYQQKPGKAPKLLIYDASNLETGVPSRFSGSGSGTDFTLTISSLQPEDFATYYCQQSYDGPITFGQGTRLEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 396 - DNA, 20 bp, Homo sapiens
  misc_feature: A2AR-1 guide RNA
cgaggagcccatgatgggca

SEQ ID NO: 397 - DNA, 20 bp, Homo sapiens
  misc_feature: A2AR-2 guide RNA
gggcaatgtgctggtgtgct

SEQ ID NO: 398 - DNA, 20 bp, Homo sapiens
  misc_feature: A2AR-3 guide RNA
cagtgacaccacaaagtagt

SEQ ID NO: 399 - protein, 26 aa, Artificial Sequence
  FW-H1_1
QVQLVQSGAEVKKPGASVKVSCKASG

SEQ ID NO: 400 - protein, 26 aa, Artificial Sequence
  FW-H1_2
QVQLVQSGAEVKKPGSSVKVSCKASG

SEQ ID NO: 401 - protein, 26 aa, Artificial Sequence
  FW-H1_3
EVQLLESGGGLVQPGGSLRLSCAASG

SEQ ID NO: 402 - protein, 26 aa, Artificial Sequence
  FW-H1_4
EVQLVESGGGLVKPGGSLRLSCAASG

SEQ ID NO: 403 - protein, 13 aa, Artificial Sequence
  FW-H2_1
WVRQAPGQGLEWM

SEQ ID NO: 404 - protein, 13 aa, Artificial Sequence
  FW-H2_2
WVRQAPGQGLEWV

SEQ ID NO: 405 - protein, 13 aa, Artificial Sequence
  FW-H2_3
WVRQAPGKGLEWV

SEQ ID NO: 406 - protein, 13 aa, Artificial Sequence
  FW-H2_4
WVRQAPGQGLEWI

SEQ ID NO: 407 - protein, 34 aa, Artificial Sequence
  FW-H3_1
QKFQGRVTMTRDTSTSTVYMELSSLRSEDTAVYY

SEQ ID NO: 408 - protein, 34 aa, Artificial Sequence
  FW-H3_2
QRFQGRVTMTRDTSTSTVYMELSSLRSEDTAVYY

SEQ ID NO: 409 - protein, 34 aa, Artificial Sequence
  FW-H3_3
HKFQGRVTMTRDTSTSTVYMELSSLRSEDTAVYY

SEQ ID NO: 410 - protein, 34 aa, Artificial Sequence
  FW-H3_4
QKFQGRVTITADESTSTAYMELSSLRSEDTAVYY

SEQ ID NO: 411 - protein, 34 aa, Artificial Sequence
  FW-H3_5
LKFQGRVTMTRDTSTSTVYMELSSLRSEDTAVYY

SEQ ID NO: 412 - protein, 34 aa, Artificial Sequence
  FW-H3_6
QNFQGRVTMTRDTSTSTVYMELSSLRSEDTAVYY

SEQ ID NO: 413 - protein, 34 aa, Artificial Sequence
  FW-H3_7
QMFQGRVTMTRDTSTSTVYMELSSLRSEDTAVYY

SEQ ID NO: 414 - protein, 34 aa, Artificial Sequence
  FW-H3_8
QEFQGRVTMTRDTSTSTVYMELSSLRSEDTAVYY

SEQ ID NO: 415 - protein, 34 aa, Artificial Sequence
  FW-H3_9
EEFQGRVTITADESTSTAYMELSSLRSEDTAVYY

SEQ ID NO: 416 - protein, 34 aa, Artificial Sequence
  FW-H3_10
QTFQGRVTMTRDTSTSTVYMELSSLRSEDTAVYY

SEQ ID NO: 417 - protein, 34 aa, Artificial Sequence
  FW-H3_11
QSFQGRVTMTRDTSTSTVYMELSSLRSEDTAVYY

SEQ ID NO: 418 - protein, 34 aa, Artificial Sequence
  FW-H3_12
DSVKGRFTISRDNSKNTLYLQMNSLRAEDTAVYY

SEQ ID NO: 419 - protein, 34 aa, Artificial Sequence
  FW-H3_13
QNLQGRVTMTRDTSTSTVYMELSSLRSEDTAVYY

SEQ ID NO: 420 - protein, 34 aa, Artificial Sequence
  FW-H3_14
PKFQGRVTITADESTSTAYMELSSLRSEDTAVYY

SEQ ID NO: 421 - protein, 34 aa, Artificial Sequence
  FW-H3_15
DSVKGRFTISRDDSKNTLYLQMNSLKTEDTAVYY

SEQ ID NO: 422 - protein, 34 aa, Artificial Sequence
  FW-H3_16
DKFQGRVTMTRDTSTSTVYMELSSLRSEDTAVYY

SEQ ID NO: 423 - protein, 10 aa, Artificial Sequence
  FW-H4_1
GQGTLVTVSS

SEQ ID NO: 424 - protein, 10 aa, Artificial Sequence
  FW-H4_2
GRGTLVTVSS

SEQ ID NO: 425 - protein, 10 aa, Artificial Sequence
  FW-H4_3
GQGTTVTVSS

SEQ ID NO: 426 - protein, 10 aa, Artificial Sequence
  FW-H4_4
GQGTMVTVSS

SEQ ID NO: 427 - protein, 10 aa, Artificial Sequence
  FW-H4_5
GKGTTVTVSS

SEQ ID NO: 428 - protein, 9 aa, Artificial Sequence
  NK77.1_CD70_DB01_C03_CDR-H1
YTFTGHYLH

SEQ ID NO: 429 - protein, 9 aa, Artificial Sequence
  NK77.2_CD70_DB01_D02_CDR-H1
YTFTNYYMH

SEQ ID NO: 430 - protein, 9 aa, Artificial Sequence
  NK77.3_CD70_DB01_E06_CDR-H1
YTFTGYYIH

SEQ ID NO: 431 - protein, 9 aa, Artificial Sequence
  NK77.4_CD70_DB01_G04_CDR-H1
GTFRSHVIS

SEQ ID NO: 432 - protein, 9 aa, Artificial Sequence
  NK77.5_CD70_DB01_G05_CDR-H1
YTFIDYYIH

SEQ ID NO: 433 - protein, 9 aa, Artificial Sequence
  NK77.6_CD70_DB01_G07_CDR-H1
YTFTSYYMH

SEQ ID NO: 434 - protein, 9 aa, Artificial Sequence
  NK77.7_CD70_DB01_G11_CDR-H1
YTFTGYYMH

SEQ ID NO: 435 - protein, 9 aa, Artificial Sequence
  NK77.9_CD70_DB02_A03_CDR-H1
YTFTENEMH

SEQ ID NO: 436 - protein, 9 aa, Artificial Sequence
  NK77.10_CD70_DB02_A04_CDR-H1
YTFTENEMH

SEQ ID NO: 437 - protein, 9 aa, Artificial Sequence
  NK77.11_CD70_DB02_A05_CDR-H1
YTFTSYYMH

SEQ ID NO: 438 - protein, 9 aa, Artificial Sequence
  NK77.12_CD70_DB02_A06_CDR-H1
YTFTGYYMH

SEQ ID NO: 439 - protein, 9 aa, Artificial Sequence
  NK77.13_CD70_DB02_A07_CDR-H1
YTFTGYYMH

SEQ ID NO: 440 - protein, 9 aa, Artificial Sequence
  NK77.14_CD70_DB02_A08_CDR-H1
YTFTSYDIN

SEQ ID NO: 441 - protein, 9 aa, Artificial Sequence
  NK77.15_CD70_DB02_A09_CDR-H1
YTFTSYYMH

SEQ ID NO: 442 - protein, 9 aa, Artificial Sequence
  NK77.16_CD70_DB02_A11_CDR-H1
YTFTSYYMH

SEQ ID NO: 443 - protein, 9 aa, Artificial Sequence
  NK77.17_CD70_DB02_B06_CDR-H1
YTFTDYYMH

SEQ ID NO: 444 - protein, 9 aa, Artificial Sequence
  NK77.18_CD70_DB02_B09_CDR-H1
YTFTGYYMH

SEQ ID NO: 445 - protein, 9 aa, Artificial Sequence
  NK77.19_CD70_DB02_C03_CDR-H1
YTFTGYYMH

SEQ ID NO: 446 - protein, 9 aa, Artificial Sequence
  NK77.20_CD70_DB02_C04_CDR-H1
GTFSSYAIS

SEQ ID NO: 447 - protein, 9 aa, Artificial Sequence
  NK77.22_CD70_DB02_C07_CDR-H1
YTFTRNYMH

SEQ ID NO: 448 - protein, 9 aa, Artificial Sequence
  NK77.24_CD70_DB02_D02_CDR-H1
YTFTSYYMH

SEQ ID NO: 449 - protein, 9 aa, Artificial Sequence
  NK77.25_CD70_DB02_D04_CDR-H1
YRLSDHYMH

SEQ ID NO: 450 - protein, 9 aa, Artificial Sequence
  NK77.26_CD70_DB02_D10_CDR-H1
YTFTDYYVH

SEQ ID NO: 451 - protein, 12 aa, Artificial Sequence
  NK77.27_CD70_DB02_D11_CDR-H1
YTFTDYTDYFVH

SEQ ID NO: 452 - protein, 9 aa, Artificial Sequence
  NK77.28_CD70_DB02_E04_CDR-H1
YIFTDYYMH

SEQ ID NO: 453 - protein, 9 aa, Artificial Sequence
  NK77.29_CD70_DB02_F06_CDR-H1
YTFTDHYIH

SEQ ID NO: 454 - protein, 9 aa, Artificial Sequence
  NK77.31_CD70_DB02_F08_CDR-H1
YTFTSYYMH

SEQ ID NO: 455 - protein, 9 aa, Artificial Sequence
  NK77.32_CD70_DB02_G07_CDR-H1
YTFTDYYMH

SEQ ID NO: 456 - protein, 9 aa, Artificial Sequence
  NK77.33_CD70_DB02_H04_CDR-H1
YTFTGYYMH

SEQ ID NO: 457 - protein, 9 aa, Artificial Sequence
  NK77.34_CD70_DB02_H05_CDR-H1
YTFTDYFTH

SEQ ID NO: 458 - protein, 9 aa, Artificial Sequence
  NK77.35_CD70_DB02_H08_CDR-H1
YTFTSYYIH

SEQ ID NO: 459 - protein, 9 aa, Artificial Sequence
  NK77.36_CD70_DB03_A06_CDR-H1
GTFSSYAIS

SEQ ID NO: 460 - protein, 9 aa, Artificial Sequence
  NK77.37_CD70_DB03_A07_CDR-H1
GTFNSYGIS

SEQ ID NO: 461 - protein, 9 aa, Artificial Sequence
  NK77.38_CD70_DB03_A08_CDR-H1
YSFTSYYMH

SEQ ID NO: 462 - protein, 9 aa, Artificial Sequence
  NK77.39_CD70_DB03_A09_CDR-H1
YTFTDYYIH

SEQ ID NO: 463 - protein, 9 aa, Artificial Sequence
  NK77.40_CD70_DB03_A11_CDR-H1
YTFNGYLMH

SEQ ID NO: 464 - protein, 9 aa, Artificial Sequence
  NK77.41_CD70_DB03_A12_CDR-H1
YTFTSYYMH

SEQ ID NO: 465 - protein, 9 aa, Artificial Sequence
  NK77.42_CD70_DB03_B01_CDR-H1
YTFSDSYMH

SEQ ID NO: 466 - protein, 9 aa, Artificial Sequence
  NK77.43_CD70_DB03_B04_CDR-H1
YIFTDYYMH

SEQ ID NO: 467 - protein, 9 aa, Artificial Sequence
  NK77.44_CD70_DB03_B06_CDR-H1
YTFTDYYLH

SEQ ID NO: 468 - protein, 9 aa, Artificial Sequence
  NK77.45_CD70_DB03_B09_CDR-H1
YTFTAYYLH

SEQ ID NO: 469 - protein, 9 aa, Artificial Sequence
  NK77.46_CD70_DB03_C05_CDR-H1
YTFTDYYIH

SEQ ID NO: 470 - protein, 9 aa, Artificial Sequence
  NK77.47_CD70_DB03_D11_CDR-H1
FTFSNSDMN

SEQ ID NO: 471 - protein, 9 aa, Artificial Sequence
  NK77.48_CD70_DB03_E01_CDR-H1
YTFTSYYMH

SEQ ID NO: 472 - protein, 9 aa, Artificial Sequence
  NK77.49_CD70_DB03_E03_CDR-H1
GTFTNYAFS

SEQ ID NO: 473 - protein, 9 aa, Artificial Sequence
  NK77.50_CD70_DB03_E09_CDR-H1
YTFTAYYMH

SEQ ID NO: 474 - protein, 9 aa, Artificial Sequence
  NK77.51_CD70_DB03_F02_CDR-H1
YTFTDYYVH

SEQ ID NO: 475 - protein, 9 aa, Artificial Sequence
  NK77.52_CD70_DB03_F05_CDR-H1
YTFTAYHMH

SEQ ID NO: 476 - protein, 9 aa, Artificial Sequence
  NK77.53_CD70_DB03_F06_CDR-H1
GTFSSYAIS

SEQ ID NO: 477 - protein, 9 aa, Artificial Sequence
  NK77.54_CD70_DB03_F09_CDR-H1
YTFTSYYMH

SEQ ID NO: 478 - protein, 9 aa, Artificial Sequence
  NK77.55_CD70_DB03_F12_CDR-H1
YTFTSYGIS

SEQ ID NO: 479 - protein, 9 aa, Artificial Sequence
  NK77.56_CD70_DB03_G06_CDR-H1
YTFIDYYMH

SEQ ID NO: 480 - protein, 9 aa, Artificial Sequence
  NK77.57_CD70_DB03_G11_CDR-H1
YTFTGQYMH

SEQ ID NO: 481 - protein, 9 aa, Artificial Sequence
  NK77.58_CD70_DB03_H08_CDR-H1
YTFTSYDIN

SEQ ID NO: 482 - protein, 9 aa, Artificial Sequence
  NK77.59_CD70_DB03_H10_CDR-H1
YTFANYYMH

SEQ ID NO: 483 - protein, 9 aa, Artificial Sequence
  NK77.60_CD70_DB04_A05_CDR-H1
YTFTTYYMH

SEQ ID NO: 484 - protein, 9 aa, Artificial Sequence
  NK77.61_CD70_DB04_A07_CDR-H1
NTFTSYYMH

SEQ ID NO: 485 - protein, 9 aa, Artificial Sequence
  NK77.62_CD70_DB04_A10_CDR-H1
FTFSSYGMH

SEQ ID NO: 486 - protein, 9 aa, Artificial Sequence
  NK77.63_CD70_DB04_A11_CDR-H1
GTFSRYDIN

SEQ ID NO: 487 - protein, 9 aa, Artificial Sequence
  NK77.64_CD70_DB04_B03_CDR-H1
YTFTSYGIS

SEQ ID NO: 488 - protein, 9 aa, Artificial Sequence
  NK77.65_CD70_DB04_B05_CDR-H1
YTFTENEMH

SEQ ID NO: 489 - protein, 9 aa, Artificial Sequence
  NK77.66_CD70_DB04_B07_CDR-H1
YTFTNYYIY

SEQ ID NO: 490 - protein, 9 aa, Artificial Sequence
  NK77.67_CD70_DB04_C01_CDR-H1
GTFSSYAIS

SEQ ID NO: 491 - protein, 9 aa, Artificial Sequence
  NK77.68_CD70_DB04_C04_CDR-H1
YTFTSYYMH

SEQ ID NO: 492 - protein, 9 aa, Artificial Sequence
  NK77.69_CD70_DB04_C06_CDR-H1
YTFTSYYIH

SEQ ID NO: 493 - protein, 9 aa, Artificial Sequence
  NK77.70_CD70_DB04_C07_CDR-H1
YTFTDSYIH

SEQ ID NO: 494 - protein, 9 aa, Artificial Sequence
  NK77.71_CD70_DB04_D02_CDR-H1
YTFTSYDIN

SEQ ID NO: 495 - protein, 9 aa, Artificial Sequence
  NK77.72_CD70_DB04_D05_CDR-H1
FVFDDYAIH

SEQ ID NO: 496 - protein, 9 aa, Artificial Sequence
  NK77.73_CD70_DB04_D07_CDR-H1
GTFRNYAIS

SEQ ID NO: 497 - protein, 9 aa, Artificial Sequence
  NK77.74_CD70_DB04_D08_CDR-H1
YTFTSYYIH

SEQ ID NO: 498 - protein, 9 aa, Artificial Sequence
  NK77.75_CD70_DB04_D10_CDR-H1
YTFTGYYMH

SEQ ID NO: 499 - protein, 9 aa, Artificial Sequence
  NK77.85_CD70_DB03_B02_CDR-H1
YTFTNYYMH

SEQ ID NO: 500 - protein, 9 aa, Artificial Sequence
  NK77.86_CD70_DB04_A06_CDR-H1
YTFTSYSMH

SEQ ID NO: 501 - protein, 9 aa, Artificial Sequence
  NK77.87_CD70_DB04_A09_CDR-H1
YTFTDYYMH

SEQ ID NO: 502 - protein, 13 aa, Artificial Sequence
  NK77.1_CD70_DB01_C03_CDR-H2
GWINPNSGGTNYA

SEQ ID NO: 503 - protein, 13 aa, Artificial Sequence
  NK77.2_CD70_DB01_D02_CDR-H2
GIINPSGGSTSYA

SEQ ID NO: 504 - protein, 13 aa, Artificial Sequence
  NK77.3_CD70_DB01_E06_CDR-H2
GIINPSGGSTSYA

SEQ ID NO: 505 - protein, 13 aa, Artificial Sequence
  NK77.4_CD70_DB01_G04_CDR-H2
GIIDPSGGSTSYA

SEQ ID NO: 506 - protein, 13 aa, Artificial Sequence
  NK77.5_CD70_DB01_G05_CDR-H2
GWMNPNSGNTGYA

SEQ ID NO: 507 - protein, 13 aa, Artificial Sequence
  NK77.6_CD70_DB01_G07_CDR-H2
GWINPNSGGTKYA

SEQ ID NO: 508 - protein, 13 aa, Artificial Sequence
  NK77.7_CD70_DB01_G11_CDR-H2
GWMNPNSGNTGYA

SEQ ID NO: 509 - protein, 13 aa, Artificial Sequence
  NK77.9_CD70_DB02_A03_CDR-H2
GGIIPIFGTANYA

SEQ ID NO: 510 - protein, 13 aa, Artificial Sequence
  NK77.10_CD70_DB02_A04_CDR-H2
GWINSNGGYTGYA

SEQ ID NO: 511 - protein, 13 aa, Artificial Sequence
  NK77.11_CD70_DB02_A05_CDR-H2
GIINPSGGSTIYA

SEQ ID NO: 512 - protein, 13 aa, Artificial Sequence
  NK77.12_CD70_DB02_A06_CDR-H2
GWINPNSGDTGYA

SEQ ID NO: 513 - protein, 13 aa, Artificial Sequence
  NK77.13_CD70_DB02_A07_CDR-H2
GIINPSGGSTSYA

SEQ ID NO: 514 - protein, 13 aa, Artificial Sequence
  NK77.14_CD70_DB02_A08_CDR-H2
GIINPSDGSTIYA

SEQ ID NO: 515 - protein, 13 aa, Artificial Sequence
  NK77.15_CD70_DB02_A09_CDR-H2
GWMNPDNGDTGYA

SEQ ID NO: 516 - protein, 13 aa, Artificial Sequence
  NK77.16_CD70_DB02_A11_CDR-H2
GWMNPNSGDTGYA

SEQ ID NO: 517 - protein, 13 aa, Artificial Sequence
  NK77.17_CD70_DB02_B06_CDR-H2
GIINPNSGGTNYA

SEQ ID NO: 518 - protein, 13 aa, Artificial Sequence
  NK77.18_CD70_DB02_B09_CDR-H2
GIINPGDGGTIYA

SEQ ID NO: 519 - protein, 13 aa, Artificial Sequence
  NK77.19_CD70_DB02_C03_CDR-H2
GIINPSGGSTSYA

SEQ ID NO: 520 - protein, 13 aa, Artificial Sequence
  NK77.20_CD70_DB02_C04_CDR-H2
GMINPSDGATTYA

SEQ ID NO: 521 - protein, 13 aa, Artificial Sequence
  NK77.22_CD70_DB02_C07_CDR-H2
GWISPDNGVTNYA

SEQ ID NO: 522 - protein, 13 aa, Artificial Sequence
  NK77.24_CD70_DB02_D02_CDR-H2
GIIDPGSGDTSYA

SEQ ID NO: 523 - protein, 13 aa, Artificial Sequence
  NK77.25_CD70_DB02_D04_CDR-H2
GIINPSGGSTTYA

SEQ ID NO: 524 - protein, 13 aa, Artificial Sequence
  NK77.26_CD70_DB02_D10_CDR-H2
GWINPNTGGTSFA

SEQ ID NO: 525 - protein, 13 aa, Artificial Sequence
  NK77.27_CD70_DB02_D11_CDR-H2
GIFNPSDGSTSYA

SEQ ID NO: 526 - protein, 13 aa, Artificial Sequence
  NK77.28_CD70_DB02_E04_CDR-H2
GIINPSGGDTLYA

SEQ ID NO: 527 - protein, 13 aa, Artificial Sequence
  NK77.29_CD70_DB02_F06_CDR-H2
GWISAYNGKTNYA

SEQ ID NO: 528 - protein, 13 aa, Artificial Sequence
  NK77.31_CD70_DB02_F08_CDR-H2
GIINPSGGATIYA

SEQ ID NO: 529 - protein, 13 aa, Artificial Sequence
  NK77.32_CD70_DB02_G07_CDR-H2
GIINPSGGSTSYA

SEQ ID NO: 530 - protein, 13 aa, Artificial Sequence
  NK77.33_CD70_DB02_H04_CDR-H2
GIINPSGGDTIYA

SEQ ID NO: 531 - protein, 13 aa, Artificial Sequence
  NK77.34_CD70_DB02_H05_CDR-H2
GWINTYDGNTNYA

SEQ ID NO: 532 - protein, 13 aa, Artificial Sequence
  NK77.35_CD70_DB02_H08_CDR-H2
GRINPNGGGTNYA

SEQ ID NO: 533 - protein, 13 aa, Artificial Sequence
  NK77.36_CD70_DB03_A06_CDR-H2
GWISPNSGDTHYA

SEQ ID NO: 534 - protein, 13 aa, Artificial Sequence
  NK77.37_CD70_DB03_A07_CDR-H2
GGIIPIFGTANYA

SEQ ID NO: 535 - protein, 13 aa, Artificial Sequence
  NK77.38_CD70_DB03_A08_CDR-H2
GIINPSGGTTSYA

SEQ ID NO: 536 - protein, 13 aa, Artificial Sequence
  NK77.39_CD70_DB03_A09_CDR-H2
GWITPNSGYTYYA

SEQ ID NO: 537 - protein, 13 aa, Artificial Sequence
  NK77.40_CD70_DB03_A11_CDR-H2
GIVNPSDGSTGYA

SEQ ID NO: 538 - protein, 13 aa, Artificial Sequence
  NK77.41_CD70_DB03_A12_CDR-H2
GIIDPSGGRTIYA

SEQ ID NO: 539 - protein, 13 aa, Artificial Sequence
  NK77.42_CD70_DB03_B01_CDR-H2
GGIIPMAGIPAYA

SEQ ID NO: 540 - protein, 13 aa, Artificial Sequence
  NK77.43_CD70_DB03_B04_CDR-H2
GIINPSGGSTSYA

SEQ ID NO: 541 - protein, 13 aa, Artificial Sequence
  NK77.44_CD70_DB03_B06_CDR-H2
GWISAYNGNTNYA

SEQ ID NO: 542 - protein, 13 aa, Artificial Sequence
  NK77.45_CD70_DB03_B09_CDR-H2
GMINPNNGGTIYA

SEQ ID NO: 543 - protein, 13 aa, Artificial Sequence
  NK77.46_CD70_DB03_C05_CDR-H2
GMINPRGGSTTYA

SEQ ID NO: 544 - protein, 13 aa, Artificial Sequence
  NK77.47_CD70_DB03_D11_CDR-H2
SAISGGGDTLYYA

SEQ ID NO: 545 - protein, 13 aa, Artificial Sequence
  NK77.48_CD70_DB03_E01_CDR-H2
GWINPNNGGTSYA

SEQ ID NO: 546 - protein, 13 aa, Artificial Sequence
  NK77.49_CD70_DB03_E03_CDR-H2
GGIIPISGAANYA

SEQ ID NO: 547 - protein, 13 aa, Artificial Sequence
  NK77.50_CD70_DB03_E09_CDR-H2
GWMNPNSGNTGYA

SEQ ID NO: 548 - protein, 13 aa, Artificial Sequence
  NK77.51_CD70_DB03_F02_CDR-H2
GTINPSGGSTSYA

SEQ ID NO: 549 - protein, 13 aa, Artificial Sequence
  NK77.52_CD70_DB03_F05_CDR-H2
GIINPGDGATGYA

SEQ ID NO: 550 - protein, 13 aa, Artificial Sequence
  NK77.53_CD70_DB03_F06_CDR-H2
GWMNPNSGNTGYA

SEQ ID NO: 551 - protein, 13 aa, Artificial Sequence
  NK77.54_CD70_DB03_F09_CDR-H2
GIFNPSDGSTSYA

SEQ ID NO: 552 - protein, 13 aa, Artificial Sequence
  NK77.55_CD70_DB03_F12_CDR-H2
GWISAYNGHTNYA

SEQ ID NO: 553 - protein, 13 aa, Artificial Sequence
  NK77.56_CD70_DB03_G06_CDR-H2
GWMNPHSGNSDNA

SEQ ID NO: 554 - protein, 13 aa, Artificial Sequence
  NK77.57_CD70_DB03_G11_CDR-H2
GWINPNTGDTNYA

SEQ ID NO: 555 - protein, 13 aa, Artificial Sequence
  NK77.58_CD70_DB03_H08_CDR-H2
GVINPSGGGTSYA

SEQ ID NO: 556 - protein, 13 aa, Artificial Sequence
  NK77.59_CD70_DB03_H10_CDR-H2
GIINPSGGSTSYA

SEQ ID NO: 557 - protein, 13 aa, Artificial Sequence
  NK77.60_CD70_DB04_A05_CDR-H2
GIINPTGGSTYYA

SEQ ID NO: 558 - protein, 13 aa, Artificial Sequence
  NK77.61_CD70_DB04_A07_CDR-H2
GWINPNSGDTNYA

SEQ ID NO: 559 - protein, 13 aa, Artificial Sequence
  NK77.62_CD70_DB04_A10_CDR-H2
ASIKHDGSEQYYV

SEQ ID NO: 560 - protein, 13 aa, Artificial Sequence
  NK77.63_CD70_DB04_A11_CDR-H2
GIIDPTGASTSYA

SEQ ID NO: 561 - protein, 13 aa, Artificial Sequence
  NK77.64_CD70_DB04_B03_CDR-H2
GGIIPIFGTTNYA

SEQ ID NO: 562 - protein, 13 aa, Artificial Sequence
  NK77.65_CD70_DB04_B05_CDR-H2
GWINPNSGGTNYA

SEQ ID NO: 563 - protein, 13 aa, Artificial Sequence
  NK77.66_CD70_DB04_B07_CDR-H2
GWINPNDGATNYA

SEQ ID NO: 564 - protein, 13 aa, Artificial Sequence
  NK77.67_CD70_DB04_C01_CDR-H2
GGITPMFGTTDYA

SEQ ID NO: 565 - protein, 13 aa, Artificial Sequence
  NK77.68_CD70_DB04_C04_CDR-H2
GIINPSDGGTSYA

SEQ ID NO: 566 - protein, 13 aa, Artificial Sequence
  NK77.69_CD70_DB04_C06_CDR-H2
GWMNPSSGVTNFA

SEQ ID NO: 567 - protein, 13 aa, Artificial Sequence
  NK77.70_CD70_DB04_C07_CDR-H2
GWMNPNTGDTGYA

SEQ ID NO: 568 - protein, 13 aa, Artificial Sequence
  NK77.71_CD70_DB04_D02_CDR-H2
GVISPSGGGTSYA

SEQ ID NO: 569 - protein, 13 aa, Artificial Sequence
  NK77.72_CD70_DB04_D05_CDR-H2
AAISYDGSNKYYA

SEQ ID NO: 570 - protein, 13 aa, Artificial Sequence
  NK77.73_CD70_DB04_D07_CDR-H2
GGIIPIFGTANYA

SEQ ID NO: 571 - protein, 13 aa, Artificial Sequence
  NK77.74_CD70_DB04_D08_CDR-H2
GWMNPNSGNAGYA

SEQ ID NO: 572 - protein, 13 aa, Artificial Sequence
  NK77.75_CD70_DB04_D10_CDR-H2
GMIDPSDGSTIYA

SEQ ID NO: 573 - protein, 13 aa, Artificial Sequence
  NK77.85_CD70_DB03_B02_CDR-H2
GWMNPDSGNTGYA

SEQ ID NO: 574 - protein, 13 aa, Artificial Sequence
  NK77.86_CD70_DB04_A06_CDR-H2
GIINPSSGSASYA

SEQ ID NO: 575 - protein, 13 aa, Artificial Sequence
  NK77.87_CD70_DB04_A09_CDR-H2
GVINPSDGTAHYA

SEQ ID NO: 576 - protein, 13 aa, Artificial Sequence
  NK77.1_CD70_DB01_C03_CDR-H3
CVRGSGWYDLDYW

SEQ ID NO: 577 - protein, 14 aa, Artificial Sequence
  NK77.2_CD70_DB01_D02_CDR-H3
CARELGVAGYFDLW

SEQ ID NO: 578 - protein, 18 aa, Artificial Sequence
  NK77.3_CD70_DB01_E06_CDR-H3
CARDLSGIDGYIGFFDYW

SEQ ID NO: 579 - protein, 14 aa, Artificial Sequence
  NK77.4_CD70_DB01_G04_CDR-H3
CAKDYTGLLGMDVW

SEQ ID NO: 580 - protein, 14 aa, Artificial Sequence
  NK77.5_CD70_DB01_G05_CDR-H3
CARGLSGYDLDDYW

SEQ ID NO: 581 - protein, 13 aa, Artificial Sequence
  NK77.6_CD70_DB01_G07_CDR-H3
CARGLSGYDFDYW

SEQ ID NO: 582 - protein, 14 aa, Artificial Sequence
  NK77.7_CD70_DB01_G11_CDR-H3
CARGTDVYGDFDYW

SEQ ID NO: 583 - protein, 21 aa, Artificial Sequence
  NK77.9_CD70_DB02_A03_CDR-H3
CAREGGTAMATGYYYYGMDVW

SEQ ID NO: 584 - protein, 14 aa, Artificial Sequence
  NK77.10_CD70_DB02_A04_CDR-H3
CARASNYGGHFDYW

SEQ ID NO: 585 - protein, 15 aa, Artificial Sequence
  NK77.11_CD70_DB02_A05_CDR-H3
CAKDMGAWAAGFDYW

SEQ ID NO: 586 - protein, 15 aa, Artificial Sequence
  NK77.12_CD70_DB02_A06_CDR-H3
CARSVNDYGDYDGYW

SEQ ID NO: 587 - protein, 15 aa, Artificial Sequence
  NK77.13_CD70_DB02_A07_CDR-H3
CARDYGDYDASFDYW

SEQ ID NO: 588 - protein, 12 aa, Artificial Sequence
  NK77.14_CD70_DB02_A08_CDR-H3
CVKEEAWYFDLW

SEQ ID NO: 589 - protein, 12 aa, Artificial Sequence
  NK77.15_CD70_DB02_A09_CDR-H3
CASGDYYDILYW

SEQ ID NO: 590 - protein, 13 aa, Artificial Sequence
  NK77.16_CD70_DB02_A11_CDR-H3
CARGPSGYEFDYW

SEQ ID NO: 591 - protein, 17 aa, Artificial Sequence
  NK77.17_CD70_DB02_B06_CDR-H3
CARDFSVYAAADGMDVW

SEQ ID NO: 592 - protein, 16 aa, Artificial Sequence
  NK77.18_CD70_DB02_B09_CDR-H3
CARGFGESAPDAFDIW

SEQ ID NO: 593 - protein, 13 aa, Artificial Sequence
  NK77.19_CD70_DB02_C03_CDR-H3
CAAGTEIYYMDVW

SEQ ID NO: 594 - protein, 22 aa, Artificial Sequence
  NK77.20_CD70_DB02_C04_CDR-H3
CARERELLHFATNYYYYGMDVW

SEQ ID NO: 595 - protein, 18 aa, Artificial Sequence
  NK77.22_CD70_DB02_C07_CDR-H3
CAKTQGSSSWYQWYFDLW

SEQ ID NO: 596 - protein, 14 aa, Artificial Sequence
  NK77.24_CD70_DB02_D02_CDR-H3
CARGSNWYDYFDYW

SEQ ID NO: 597 - protein, 14 aa, Artificial Sequence
  NK77.25_CD70_DB02_D04_CDR-H3
CASSYYGDYVLVNW

SEQ ID NO: 598 - protein, 15 aa, Artificial Sequence
  NK77.26_CD70_DB02_D10_CDR-H3
CARDLGQWLGEIDYW

SEQ ID NO: 599 - protein, 16 aa, Artificial Sequence [sequence omitted]

SEQ ID NO: 600 - protein, 15 aa, Artificial Sequence
  NK77.28_CD70_DB02_E04_CDR-H3
CAREGVGAMGVFDYW

SEQ ID NO: 601 - protein, 17 aa, Artificial Sequence
  NK77.29_CD70_DB02_F06_CDR-H3
CARDTIYYDFWSGYDYW

SEQ ID NO: 602 - protein, 17 aa, Artificial Sequence
  NK77.31_CD70_DB02_F08_CDR-H3
CARSRGDYYGSGDFDYW

SEQ ID NO: 603 - protein, 13 aa, Artificial Sequence
  NK77.32_CD70_DB02_G07_CDR-H3
CARGYFDHAFDIW

SEQ ID NO: 604 - protein, 19 aa, Artificial Sequence
  NK77.33_CD70_DB02_H04_CDR-H3
CARGDSSSWYDYYYYMDVW

SEQ ID NO: 605 - protein, 14 aa, Artificial Sequence
  NK77.34_CD70_DB02_H05_CDR-H3
CAREMEWLGQVDYW

SEQ ID NO: 606 - protein, 14 aa, Artificial Sequence
  NK77.35_CD70_DB02_H08_CDR-H3
CARGHRGGGGIDYW

SEQ ID NO: 607 - protein, 14 aa, Artificial Sequence
  NK77.36_CD70_DB03_A06_CDR-H3
CARDWGSGWYVDYW

SEQ ID NO: 608 - protein, 14 aa, Artificial Sequence
  NK77.37_CD70_DB03_A07_CDR-H3
CARDTYGDDAFDIW

SEQ ID NO: 609 - protein, 19 aa, Artificial Sequence
  NK77.38_CD70_DB03_A08_CDR-H3
CARDNSPYSSSWWDYFDYW

SEQ ID NO: 610 - protein, 17 aa, Artificial Sequence
  NK77.39_CD70_DB03_A09_CDR-H3
CARNTDCYGDFLGLDVW

SEQ ID NO: 611 - protein, 17 aa, Artificial Sequence
  NK77.40_CD70_DB03_A11_CDR-H3
CAKDTGLRYFDWLLDYW

SEQ ID NO: 612 - protein, 13 aa, Artificial Sequence
  NK77.41_CD70_DB03_A12_CDR-H3
CARHEAGGIFDYW

SEQ ID NO: 613 - protein, 16 aa, Artificial Sequence
  NK77.42_CD70_DB03_B01_CDR-H3
CARADDYGGNWYFDLW

SEQ ID NO: 614 - protein, 15 aa, Artificial Sequence
  NK77.43_CD70_DB03_B04_CDR-H3
CARDSGWYESWFDPW

SEQ ID NO: 615 - protein, 17 aa, Artificial Sequence
  NK77.44_CD70_DB03_B06_CDR-H3
CAREIVGATEDWYFDLW

SEQ ID NO: 616 - protein, 14 aa, Artificial Sequence
  NK77.45_CD70_DB03_B09_CDR-H3
CARDLGGYVLFDYW

SEQ ID NO: 617 - protein, 14 aa, Artificial Sequence
  NK77.46_CD70_DB03_C05_CDR-H3
CARDLGDYGDYDYW

SEQ ID NO: 618 - protein, 19 aa, Artificial Sequence
  NK77.47_CD70_DB03_D11_CDR-H3
CAMASALDSSGDNEAFDIW

SEQ ID NO: 619 - protein, 17 aa, Artificial Sequence
  NK77.48_CD70_DB03_E01_CDR-H3
CARVEDDFWSGPSFDYW

SEQ ID NO: 620 - protein, 14 aa, Artificial Sequence
  NK77.49_CD70_DB03_E03_CDR-H3
CARGSGLDDAFDIW

SEQ ID NO: 621 - protein, 24 aa, Artificial Sequence
  NK77.50_CD70_DB03_E09_CDR-H3
CAREGRIDYGDYDDYYYYYGMDVW

SEQ ID NO: 622 - protein, 15 aa, Artificial Sequence
  NK77.51_CD70_DB03_F02_CDR-H3
CARDQGLWFTGFDYW

SEQ ID NO: 623 - protein, 15 aa, Artificial Sequence
  NK77.52_CD70_DB03_F05_CDR-H3
CAGEGISGSDAFDIW

SEQ ID NO: 624 - protein, 13 aa, Artificial Sequence
  NK77.53_CD70_DB03_F06_CDR-H3
CAWGVDPYYFDYW

SEQ ID NO: 625 - protein, 13 aa, Artificial Sequence
  NK77.54_CD70_DB03_F09_CDR-H3
CARDVGETTFDPW

SEQ ID NO: 626 - protein, 18 aa, Artificial Sequence
  NK77.55_CD70_DB03_F12_CDR-H3
CARDSVRGWDYYYGMGVW

SEQ ID NO: 627 - protein, 15 aa, Artificial Sequence
  NK77.56_CD70_DB03_G06_CDR-H3
CARGYSGYDLTADYW

SEQ ID NO: 628 - protein, 24 aa, Artificial Sequence
  NK77.57_CD70_DB03_G11_CDR-H3
CARDSVFEVEGGTDYYYYYGMDVW

SEQ ID NO: 629 - protein, 14 aa, Artificial Sequence
  NK77.58_CD70_DB03_H08_CDR-H3
CARYSGYDWVFDYW

SEQ ID NO: 630 - protein, 15 aa, Artificial Sequence
  NK77.59_CD70_DB03_H10_CDR-H3
CARDSGSYFGWFDPW

SEQ ID NO: 631 - protein, 15 aa, Artificial Sequence
  NK77.60_CD70_DB04_A05_CDR-H3
CARDSGNYQGIFDYW

SEQ ID NO: 632 - protein, 14 aa, Artificial Sequence
  NK77.61_CD70_DB04_A07_CDR-H3
CARGVSGYDLFDYW

SEQ ID NO: 633 - protein, 9 aa, Artificial Sequence
  NK77.62_CD70_DB04_A10_CDR-H3
CAASGVDVW

SEQ ID NO: 634 - protein, 17 aa, Artificial Sequence
  NK77.63_CD70_DB04_A11_CDR-H3
CARDYSYGMDYYGMDVW

SEQ ID NO: 635 - protein, 14 aa, Artificial Sequence
  NK77.64_CD70_DB04_B03_CDR-H3
CARDHSGDGYFDLW

SEQ ID NO: 636 - protein, 13 aa, Artificial Sequence
  NK77.65_CD70_DB04_B05_CDR-H3
CAGSWGGYYFDYW

SEQ ID NO: 637 - protein, 16 aa, Artificial Sequence
  NK77.66_CD70_DB04_B07_CDR-H3
CAREGNDYYYYFMDYW

SEQ ID NO: 638 - protein, 17 aa, Artificial Sequence
  NK77.67_CD70_DB04_C01_CDR-H3
CARDERDGYATVAFDIW

SEQ ID NO: 639 - protein, 17 aa, Artificial Sequence
  NK77.68_CD70_DB04_C04_CDR-H3
CARALAPLGWGDGMDVW

SEQ ID NO: 640 - protein, 14 aa, Artificial Sequence
  NK77.69_CD70_DB04_C06_CDR-H3
CARGSDQGDWSDPW

SEQ ID NO: 641 - protein, 17 aa, Artificial Sequence
  NK77.70_CD70_DB04_C07_CDR-H3
CAKDDFGELAPATFDPW

SEQ ID NO: 642 - protein, 17 aa, Artificial Sequence
  NK77.71_CD70_DB04_D02_CDR-H3
CARYYGGNPEGWYFDLW

SEQ ID NO: 643 - protein, 27 aa, Artificial Sequence
  NK77.72_CD70_DB04_D05_CDR-H3
CARAPQYYGSGTDPLEVRYYYYGMDVW

SEQ ID NO: 644 - protein, 17 aa, Artificial Sequence
  NK77.73_CD70_DB04_D07_CDR-H3
CARDHSAGTHHDAFDIW

SEQ ID NO: 645 - protein, 12 aa, Artificial Sequence
  NK77.74_CD70_DB04_D08_CDR-H3
CAREYWGSFDYW

SEQ ID NO: 646 - protein, 13 aa, Artificial Sequence
  NK77.75_CD70_DB04_D10_CDR-H3
CARERPLYASDLW

SEQ ID NO: 647 - protein, 14 aa, Artificial Sequence
  NK77.85_CD70_DB03_B02_CDR-H3
CARSSSSWPDFDLW

SEQ ID NO: 648 - protein, 15 aa, Artificial Sequence
  NK77.86_CD70_DB04_A06_CDR-H3
CARERGAYSSTFDYW

SEQ ID NO: 649 - protein, 15 aa, Artificial Sequence
  NK77.87_CD70_DB04_A09_CDR-H3
CARDSGSYYADFDYW

SEQ ID NO: 650 - protein, 23 aa, Artificial Sequence
  FW-L1_1
DIQMTQSPSSLSASVGDRVTITC

SEQ ID NO: 651 - protein, 23 aa, Artificial Sequence
  FW-L1_2
DIVMTQSPLSLPVTPGEPASISC

SEQ ID NO: 652 - protein, 23 aa, Artificial Sequence
  FW-L1_3
EIVMTQSPATLSVSPGERATLSC

SEQ ID NO: 653 - protein, 23 aa, Artificial Sequence
  FW-L1_4
DIVMTQSPDSLAVSLGERATINC

SEQ ID NO: 654 - protein, 15 aa, Artificial Sequence
  FW-L2_1
WYQQKPGKAPKLLIY

SEQ ID NO: 655 - protein, 15 aa, Artificial Sequence
  FW-L2_2
WYLQKPGQSPQLLIY

SEQ ID NO: 656 - protein, 15 aa, Artificial Sequence
  FW-L2_3
WYQQKPGQAPRLLIY

SEQ ID NO: 657 - protein, 15 aa, Artificial Sequence
  FW-L2_4
WYQQKPGQPPKLLIY

SEQ ID NO: 658 - protein, 31 aa, Artificial Sequence
  FW-L3_1
GVPSRFSGSGSGTDFTLTISSLQPEDFATYY

SEQ ID NO: 659 - protein, 31 aa, Artificial Sequence
  FW-L3_2
GVPDRFSGSGSGTDFTLKISRVEAEDVGVYY

SEQ ID NO: 660 - protein, 31 aa, Artificial Sequence
  FW-L3_3
GIPARFSGSGSGTEFTLTISSLQSEDFAVYY

SEQ ID NO: 661 - protein, 31 aa, Artificial Sequence
  FW-L3_4
GVPDRFSGSGSGTDFTLTISSLQAEDVAVYY

SEQ ID NO: 662 - protein, 9 aa, Artificial Sequence
  FW-L4_1
GQGTRLEIK

SEQ ID NO: 663 - protein, 9 aa, Artificial Sequence
  FW-L4_2
GQGTKLEIK

SEQ ID NO: 664 - protein, 9 aa, Artificial Sequence
  FW-L4_3
GQGTKVEIK

SEQ ID NO: 665 - protein, 9 aa, Artificial Sequence
  FW-L4_4
GGGTKVEIK

SEQ ID NO: 666 - protein, 9 aa, Artificial Sequence
  FW-L4_5
GPGTKVDIK

SEQ ID NO: 667 - protein, 9 aa, Artificial Sequence
  FW-L4_6
GGGTKLEIK

SEQ ID NO: 668 - protein, 11 aa, Artificial Sequence
  NK77.1_CD70_DB01_C03_CDR-L1
RASQNIGTYLA

SEQ ID NO: 669 - protein, 11 aa, Artificial Sequence
  NK77.2_CD70_DB01_D02_CDR-L1
RASQRISNWLA

SEQ ID NO: 670 - protein, 16 aa, Artificial Sequence
  NK77.3_CD70_DB01_E06_CDR-L1
RSSQSLLHSNGYNYLD

SEQ ID NO: 671 - protein, 11 aa, Artificial Sequence
  NK77.4_CD70_DB01_G04_CDR-L1
RASQDIDTYLA

SEQ ID NO: 672 - protein, 11 aa, Artificial Sequence
  NK77.5_CD70_DB01_G05_CDR-L1
QASQDISNYLN

SEQ ID NO: 673 - protein, 11 aa, Artificial Sequence
  NK77.6_CD70_DB01_G07_CDR-L1
QASQDISNYLN

SEQ ID NO: 674 - protein, 11 aa, Artificial Sequence
  NK77.7_CD70_DB01_G11_CDR-L1
RASQSISSYLN

SEQ ID NO: 675 - protein, 11 aa, Artificial Sequence
  NK77.9_CD70_DB02_A03_CDR-L1
QASQDISNYLN

SEQ ID NO: 676 - protein, 16 aa, Artificial Sequence
  NK77.10_CD70_DB02_A04_CDR-L1
RSSQSLLHSNGYNYLD

SEQ ID NO: 677 - protein, 11 aa, Artificial Sequence
  NK77.11_CD70_DB02_A05_CDR-L1
QASQDISNYLN

SEQ ID NO: 678 - protein, 11 aa, Artificial Sequence
  NK77.12_CD70_DB02_A06_CDR-L1
QASQDISNYLN

SEQ ID NO: 679 - protein, 11 aa, Artificial Sequence
  NK77.13_CD70_DB02_A07_CDR-L1
RASQSIDNWLA

SEQ ID NO: 680 - protein, 11 aa, Artificial Sequence
  NK77.14_CD70_DB02_A08_CDR-L1
QASQDISNYLN

SEQ ID NO: 681 - protein, 11 aa, Artificial Sequence
  NK77.15_CD70_DB02_A09_CDR-L1
QASQDISNYLN

SEQ ID NO: 682 - protein, 11 aa, Artificial Sequence
  NK77.16_CD70_DB02_A11_CDR-L1
RASQTISNYLN

SEQ ID NO: 683 - protein, 11 aa, Artificial Sequence
  NK77.17_CD70_DB02_B06_CDR-L1
RASQSISSYLN

SEQ ID NO: 684 - protein, 11 aa, Artificial Sequence
  NK77.18_CD70_DB02_B09_CDR-L1
QASQDISNYLN

SEQ ID NO: 685 - protein, 11 aa, Artificial Sequence
  NK77.19_CD70_DB02_C03_CDR-L1
RASQTIDIYLN

SEQ ID NO: 686 - protein, 11 aa, Artificial Sequence
  NK77.20_CD70_DB02_C04_CDR-L1
RASQGISNNLN

SEQ ID NO: 687 - protein, 11 aa, Artificial Sequence
  NK77.22_CD70_DB02_C07_CDR-L1
RASQSIGTWLA

SEQ ID NO: 688 - protein, 11 aa, Artificial Sequence
  NK77.24_CD70_DB02_D02_CDR-L1
RASQSVSSYLA

SEQ ID NO: 689 - protein, 11 aa, Artificial Sequence
  NK77.25_CD70_DB02_D04_CDR-L1
QASQDISNYLN

SEQ ID NO: 690 - protein, 11 aa, Artificial Sequence
  NK77.26_CD70_DB02_D10_CDR-L1
RASQTIYKWLA

SEQ ID NO: 691 - protein, 11 aa, Artificial Sequence
  NK77.27_CD70_DB02_D11_CDR-L1
QASQDISNYLN

SEQ ID NO: 692 - protein, 11 aa, Artificial Sequence
  NK77.28_CD70_DB02_E04_CDR-L1
RASTSISDYVH

SEQ ID NO: 693 - protein, 11 aa, Artificial Sequence
  NK77.29_CD70_DB02_F06_CDR-L1
RASQGISNNLN

SEQ ID NO: 694 - protein, 11 aa, Artificial Sequence
  NK77.31_CD70_DB02_F08_CDR-L1
RASQTISNYLN

SEQ ID NO: 695 - protein, 11 aa, Artificial Sequence
  NK77.32_CD70_DB02_G07_CDR-L1
RASQSISTYLN

SEQ ID NO: 696 - protein, 11 aa, Artificial Sequence
  NK77.33_CD70_DB02_H04_CDR-L1
QASQDISNYLN

SEQ ID NO: 697 - protein, 11 aa, Artificial Sequence
  NK77.34_CD70_DB02_H05_CDR-L1
RASQDIRNDLG

SEQ ID NO: 698 - protein, 11 aa, Artificial Sequence
  NK77.35_CD70_DB02_H08_CDR-L1
RASQEISNYLA

SEQ ID NO: 699 - protein, 11 aa, Artificial Sequence
  NK77.36_CD70_DB03_A06_CDR-L1
QASQDISDSLN

SEQ ID NO: 700 - protein, 11 aa, Artificial Sequence
  NK77.37_CD70_DB03_A07_CDR-L1
RASQSISSWLA

SEQ ID NO: 701 - protein, 11 aa, Artificial Sequence
  NK77.38_CD70_DB03_A08_CDR-L1
RASQDIRHYLA

SEQ ID NO: 702 - protein, 11 aa, Artificial Sequence
  NK77.39_CD70_DB03_A09_CDR-L1
RASSSISNYLA

SEQ ID NO: 703 - protein, 11 aa, Artificial Sequence
  NK77.40_CD70_DB03_A11_CDR-L1
RASQGITNFLA

SEQ ID NO: 704 - protein, 11 aa, Artificial Sequence
  NK77.41_CD70_DB03_A12_CDR-L1
QASQDISNYLN

SEQ ID NO: 705 - protein, 16 aa, Artificial Sequence
  NK77.42_CD70_DB03_B01_CDR-L1
RSSQSLLHSNGYNYLD

SEQ ID NO: 706 - protein, 11 aa, Artificial Sequence
  NK77.43_CD70_DB03_B04_CDR-L1
RASQDIRDGLG

SEQ ID NO: 707 - protein, 11 aa, Artificial Sequence
  NK77.44_CD70_DB03_B06_CDR-L1
RASQSVSSYLA

SEQ ID NO: 708 - protein, 11 aa, Artificial Sequence
  NK77.45_CD70_DB03_B09_CDR-L1
RASQSISSYLN

SEQ ID NO: 709 - protein, 11 aa, Artificial Sequence
  NK77.46_CD70_DB03_C05_CDR-L1
RASQSISTNLA

SEQ ID NO: 710 - protein, 17 aa, Artificial Sequence
  NK77.47_CD70_DB03_D11_CDR-L1
KSSQSVLYSSNNKNYLA

SEQ ID NO: 711 - protein, 11 aa, Artificial Sequence
  NK77.48_CD70_DB03_E01_CDR-L1
QASHDISKFLN

SEQ ID NO: 712 - protein, 16 aa, Artificial Sequence
  NK77.49_CD70_DB03_E03_CDR-L1
RSSQSLLHSNGYNYLD

SEQ ID NO: 713 - protein, 16 aa, Artificial Sequence
  NK77.50_CD70_DB03_E09_CDR-L1
RSSQSLLHSNGYNYLD

SEQ ID NO: 714 - protein, 11 aa, Artificial Sequence
  NK77.51_CD70_DB03_F02_CDR-L1
RASQGISNNLN

SEQ ID NO: 715 - protein, 11 aa, Artificial Sequence
  NK77.52_CD70_DB03_F05_CDR-L1
RASQSISSWLA

SEQ ID NO: 716 - protein, 11 aa, Artificial Sequence
  NK77.53_CD70_DB03_F06_CDR-L1
RASQSINRWLA

SEQ ID NO: 717 - protein, 11 aa, Artificial Sequence
  NK77.54_CD70_DB03_F09_CDR-L1
QASQDISNYLN

SEQ ID NO: 718 - protein, 11 aa, Artificial Sequence
  NK77.55_CD70_DB03_F12_CDR-L1
QASQDIRNFLN

SEQ ID NO: 719 - protein, 11 aa, Artificial Sequence
  NK77.56_CD70_DB03_G06_CDR-L1
RASQSISNYLN

SEQ ID NO: 720 - protein, 11 aa, Artificial Sequence
  NK77.57_CD70_DB03_G11_CDR-L1
RASETISGWLA

SEQ ID NO: 721 - protein, 11 aa, Artificial Sequence
  NK77.58_CD70_DB03_H08_CDR-L1
RASQGIGSWLA

SEQ ID NO: 722 - protein, 11 aa, Artificial Sequence
  NK77.59_CD70_DB03_H10_CDR-L1
RASQSISSSLA

SEQ ID NO: 723 - protein, 11 aa, Artificial Sequence
  NK77.60_CD70_DB04_A05_CDR-L1
RASQGIGGYLA

SEQ ID NO: 724 - protein, 11 aa, Artificial Sequence
  NK77.61_CD70_DB04_A07_CDR-L1
RASQSVSSYLN

SEQ ID NO: 725 - protein, 16 aa, Artificial Sequence
  NK77.62_CD70_DB04_A10_CDR-L1
RSSQSLLHSNGYNYLD

SEQ ID NO: 726 - protein, 11 aa, Artificial Sequence
  NK77.63_CD70_DB04_A11_CDR-L1
QASQDISNYLN

SEQ ID NO: 727 - protein, 16 aa, Artificial Sequence
  NK77.64_CD70_DB04_B03_CDR-L1
RSSQSLLHSNGYNYLD

SEQ ID NO: 728 - protein, 11 aa, Artificial Sequence
  NK77.65_CD70_DB04_B05_CDR-L1
RASQSVSRYLN

SEQ ID NO: 729 - protein, 11 aa, Artificial Sequence
  NK77.66_CD70_DB04_B07_CDR-L1
RASQGISNNLN

SEQ ID NO: 730 - protein, 16 aa, Artificial Sequence
  NK77.67_CD70_DB04_C01_CDR-L1
RSSQSLLHSNGYNYLD

SEQ ID NO: 731 - protein, 11 aa, Artificial Sequence
  NK77.68_CD70_DB04_C04_CDR-L1
QASQDISNYLN

SEQ ID NO: 732 - protein, 11 aa, Artificial Sequence
  NK77.69_CD70_DB04_C06_CDR-L1
RASQSISSYLN

SEQ ID NO: 733 - protein, 11 aa, Artificial Sequence
  NK77.70_CD70_DB04_C07_CDR-L1
QASQDISNYLN

SEQ ID NO: 734 - protein, 11 aa, Artificial Sequence
  NK77.71_CD70_DB04_D02_CDR-L1
RASQSIGNWLA

SEQ ID NO: 735 - protein, 16 aa, Artificial Sequence
  NK77.72_CD70_DB04_D05_CDR-L1
RSSQSLLHSNGYNYLD

SEQ ID NO: 736 - protein, 11 aa, Artificial Sequence
  NK77.73_CD70_DB04_D07_CDR-L1
RASQGISNYLA

SEQ ID NO: 737 - protein, 11 aa, Artificial Sequence
  NK77.74_CD70_DB04_D08_CDR-L1
RASQGISNNLN

SEQ ID NO: 738 - protein, 11 aa, Artificial Sequence
  NK77.75_CD70_DB04_D10_CDR-L1
RASQDIGNDLG

SEQ ID NO: 739 - protein, 11 aa, Artificial Sequence
  NK77.85_CD70_DB03_B02_CDR-L1
RASQSISSYLN

SEQ ID NO: 740 - protein, 11 aa, Artificial Sequence
  NK77.86_CD70_DB04_A06_CDR-L1
RTSQSISSYLN

SEQ ID NO: 741 - protein, 11 aa, Artificial Sequence
  NK77.87_CD70_DB04_A09_CDR-L1
QASQDISNYLN

SEQ ID NO: 742 - protein, 7 aa, Artificial Sequence
  NK77.1_CD70_DB01_C03_CDR-L2
DASNLET

SEQ ID NO: 743 - protein, 7 aa, Artificial Sequence
  NK77.2_CD70_DB01_D02_CDR-L2
DASNLET

SEQ ID NO: 744 - protein, 7 aa, Artificial Sequence
  NK77.3_CD70_DB01_E06_CDR-L2
AASSLQS

SEQ ID NO: 745 - protein, 7 aa, Artificial Sequence
  NK77.4_CD70_DB01_G04_CDR-L2
AASSLQS

SEQ ID NO: 746 - protein, 7 aa, Artificial Sequence
  NK77.5_CD70_DB01_G05_CDR-L2
DASSLES

SEQ ID NO: 747 - protein, 7 aa, Artificial Sequence
  NK77.6_CD70_DB01_G07_CDR-L2
DASNLET

SEQ ID NO: 748 - protein, 7 aa, Artificial Sequence
  NK77.7_CD70_DB01_G11_CDR-L2
DASYLET

SEQ ID NO: 749 - protein, 7 aa, Artificial Sequence
  NK77.9_CD70_DB02_A03_CDR-L2
DASNLET

SEQ ID NO: 750 - protein, 7 aa, Artificial Sequence
  NK77.10_CD70_DB02_A04_CDR-L2
QASSLES

SEQ ID NO: 751 - protein, 7 aa, Artificial Sequence
  NK77.11_CD70_DB02_A05_CDR-L2
ATSTLAN

SEQ ID NO: 752 - protein, 7 aa, Artificial Sequence
  NK77.12_CD70_DB02_A06_CDR-L2
DASNLET

SEQ ID NO: 753 - protein, 7 aa, Artificial Sequence
  NK77.13_CD70_DB02_A07_CDR-L2
AASTLQS

SEQ ID NO: 754 - protein, 7 aa, Artificial Sequence
  NK77.14_CD70_DB02_A08_CDR-L2
DASNLET

SEQ ID NO: 755 - protein, 7 aa, Artificial Sequence
  NK77.15_CD70_DB02_A09_CDR-L2
DVSNLET

SEQ ID NO: 756 - protein, 7 aa, Artificial Sequence
  NK77.16_CD70_DB02_A11_CDR-L2
DASSLES

SEQ ID NO: 757 - protein, 7 aa, Artificial Sequence
  NK77.17_CD70_DB02_B06_CDR-L2
DASNLAT

SEQ ID NO: 758 - protein, 7 aa, Artificial Sequence
  NK77.18_CD70_DB02_B09_CDR-L2
GATTLQS

SEQ ID NO: 759 - protein, 7 aa, Artificial Sequence
  NK77.19_CD70_DB02_C03_CDR-L2
DASNLET

SEQ ID NO: 760 - protein, 7 aa, Artificial Sequence
  NK77.20_CD70_DB02_C04_CDR-L2
AASSLHS

SEQ ID NO: 761 - protein, 7 aa, Artificial Sequence
  NK77.22_CD70_DB02_C07_CDR-L2
AASSLQS

SEQ ID NO: 762 - protein, 7 aa, Artificial Sequence
  NK77.24_CD70_DB02_D02_CDR-L2
GASTRAT

SEQ ID NO: 763 - protein, 7 aa, Artificial Sequence
  NK77.25_CD70_DB02_D04_CDR-L2
AASTLES

SEQ ID NO: 764 - protein, 7 aa, Artificial Sequence
  NK77.26_CD70_DB02_D10_CDR-L2
DASSLES

SEQ ID NO: 765 - protein, 7 aa, Artificial Sequence
  NK77.27_CD70_DB02_D11_CDR-L2
DASNLET

SEQ ID NO: 766 - protein, 7 aa, Artificial Sequence
  NK77.28_CD70_DB02_E04_CDR-L2
DASSLQS

SEQ ID NO: 767 - protein, 7 aa, Artificial Sequence
  NK77.29_CD70_DB02_F06_CDR-L2
YASTLQS

SEQ ID NO: 768 - protein, 7 aa, Artificial Sequence
  NK77.31_CD70_DB02_F08_CDR-L2
DASTLEA

SEQ ID NO: 769 - protein, 7 aa, Artificial Sequence
  NK77.32_CD70_DB02_G07_CDR-L2
DASNLEI

SEQ ID NO: 770 - protein, 7 aa, Artificial Sequence
  NK77.33_CD70_DB02_H04_CDR-L2
AASSLQS

SEQ ID NO: 771 - protein, 7 aa, Artificial Sequence
  NK77.34_CD70_DB02_H05_CDR-L2
AASNLET

SEQ ID NO: 772 - protein, 7 aa, Artificial Sequence
  NK77.35_CD70_DB02_H08_CDR-L2
DASNLQT

SEQ ID NO: 773 - protein, 7 aa, Artificial Sequence
  NK77.36_CD70_DB03_A06_CDR-L2
SASSLQS

SEQ ID NO: 774 - protein, 7 aa, Artificial Sequence
  NK77.37_CD70_DB03_A07_CDR-L2
DASNLET

SEQ ID NO: 775 - protein, 7 aa, Artificial Sequence
  NK77.38_CD70_DB03_A08_CDR-L2
DASSLQS

SEQ ID NO: 776 - protein, 7 aa, Artificial Sequence
  NK77.39_CD70_DB03_A09_CDR-L2
GASTRAS

SEQ ID NO: 777 - protein, 7 aa, Artificial Sequence
  NK77.40_CD70_DB03_A11_CDR-L2
DASNLET

SEQ ID NO: 778 - protein, 7 aa, Artificial Sequence
  NK77.41_CD70_DB03_A12_CDR-L2
SASTLQS

SEQ ID NO: 779 - protein, 7 aa, Artificial Sequence
  NK77.42_CD70_DB03_B01_CDR-L2
AASSLQS

SEQ ID NO: 780 - protein, 7 aa, Artificial Sequence
  NK77.43_CD70_DB03_B04_CDR-L2
AASTLQS

SEQ ID NO: 781 - protein, 7 aa, Artificial Sequence
  NK77.44_CD70_DB03_B06_CDR-L2
GASTRAT

SEQ ID NO: 782 - protein, 7 aa, Artificial Sequence
  NK77.45_CD70_DB03_B09_CDR-L2
DASNLET

SEQ ID NO: 783 - protein, 7 aa, Artificial Sequence
  NK77.46_CD70_DB03_C05_CDR-L2
DASYLEA

SEQ ID NO: 784 - protein, 7 aa, Artificial Sequence
  NK77.47_CD70_DB03_D11_CDR-L2
WASTRDS

SEQ ID NO: 785 - protein, 7 aa, Artificial Sequence
  NK77.48_CD70_DB03_E01_CDR-L2
DASNLQR

SEQ ID NO: 786 - protein, 7 aa, Artificial Sequence
  NK77.49_CD70_DB03_E03_CDR-L2
DASSLQS

SEQ ID NO: 787 - protein, 7 aa, Artificial Sequence
  NK77.50_CD70_DB03_E09_CDR-L2
AASNLQG

SEQ ID NO: 788 - protein, 7 aa, Artificial Sequence
  NK77.51_CD70_DB03_F02_CDR-L2
DASNLER

SEQ ID NO: 789 - protein, 7 aa, Artificial Sequence
  NK77.52_CD70_DB03_F05_CDR-L2
AASSLQS

SEQ ID NO: 790 - protein, 7 aa, Artificial Sequence
  NK77.53_CD70_DB03_F06_CDR-L2
DASNLET

SEQ ID NO: 791 - protein, 7 aa, Artificial Sequence
  NK77.54_CD70_DB03_F09_CDR-L2
DASSLES

SEQ ID NO: 792 - protein, 7 aa, Artificial Sequence
  NK77.55_CD70_DB03_F12_CDR-L2
AASTLQS

SEQ ID NO: 793 - protein, 7 aa, Artificial Sequence
  NK77.56_CD70_DB03_G06_CDR-L2
DASNLET

SEQ ID NO: 794 - protein, 7 aa, Artificial Sequence
  NK77.57_CD70_DB03_G11_CDR-L2
DASNLET

SEQ ID NO: 795 - protein, 7 aa, Artificial Sequence
  NK77.58_CD70_DB03_H08_CDR-L2
AASTLQS

SEQ ID NO: 796 - protein, 7 aa, Artificial Sequence
  NK77.59_CD70_DB03_H10_CDR-L2
DASSLQS

SEQ ID NO: 797 - protein, 7 aa, Artificial Sequence
  NK77.60_CD70_DB04_A05_CDR-L2
DASNLET

SEQ ID NO: 798 - protein, 7 aa, Artificial Sequence
  NK77.61_CD70_DB04_A07_CDR-L2
DTSNLET

SEQ ID NO: 799 - protein, 7 aa, Artificial Sequence
  NK77.62_CD70_DB04_A10_CDR-L2
LGSTRAS

SEQ ID NO: 800 - protein, 7 aa, Artificial Sequence
  NK77.63_CD70_DB04_A11_CDR-L2
DTSNLQT

SEQ ID NO: 801 - protein, 7 aa, Artificial Sequence
  NK77.64_CD70_DB04_B03_CDR-L2
DASSLQS

SEQ ID NO: 802 - protein, 7 aa, Artificial Sequence
  NK77.65_CD70_DB04_B05_CDR-L2
DASNLET

SEQ ID NO: 803 - protein, 7 aa, Artificial Sequence
  NK77.66_CD70_DB04_B07_CDR-L2
HASNLET

SEQ ID NO: 804 - protein, 7 aa, Artificial Sequence
  NK77.67_CD70_DB04_C01_CDR-L2
DASNLET

SEQ ID NO: 805 - protein, 7 aa, Artificial Sequence
  NK77.68_CD70_DB04_C04_CDR-L2
DASNLET

SEQ ID NO: 806 - protein, 7 aa, Artificial Sequence
  NK77.69_CD70_DB04_C06_CDR-L2
DASNLET

SEQ ID NO: 807 - protein, 7 aa, Artificial Sequence
  NK77.70_CD70_DB04_C07_CDR-L2
GASSLQS

SEQ ID NO: 808 - protein, 7 aa, Artificial Sequence
  NK77.71_CD70_DB04_D02_CDR-L2
DASDLET

SEQ ID NO: 809 - protein, 7 aa, Artificial Sequence
  NK77.72_CD70_DB04_D05_CDR-L2
EVSNRAS

SEQ ID NO: 810 - protein, 7 aa, Artificial Sequence
  NK77.73_CD70_DB04_D07_CDR-L2
AASSLQS

SEQ ID NO: 811 - protein, 7 aa, Artificial Sequence
  NK77.74_CD70_DB04_D08_CDR-L2
DASNLET

SEQ ID NO: 812 - protein, 7 aa, Artificial Sequence
  NK77.75_CD70_DB04_D10_CDR-L2
AASSLQS

SEQ ID NO: 813 - protein, 7 aa, Artificial Sequence
  NK77.85_CD70_DB03_B02_CDR-L2
DASNLET

SEQ ID NO: 814 - protein, 7 aa, Artificial Sequence
  NK77.86_CD70_DB04_A06_CDR-L2
DASNLET

SEQ ID NO: 815 - protein, 7 aa, Artificial Sequence
  NK77.87_CD70_DB04_A09_CDR-L2
DASSLQS

SEQ ID NO: 816 - protein, 11 aa, Artificial Sequence [sequence omitted]

SEQ ID NO: 817 - protein, 11 aa, Artificial Sequence [sequence omitted]

SEQ ID NO: 818 - protein, 11 aa, Artificial Sequence [sequence omitted]

SEQ ID NO: 819 - protein, 11 aa, Artificial Sequence [sequence omitted]

SEQ ID NO: 820 - protein, 11 aa, Artificial Sequence [sequence omitted]

SEQ ID NO: 821 - protein, 11 aa, Artificial Sequence
  NK77.6_CD70_DB01_G07_CDR-L3
CQQAYRWPITF

SEQ ID NO: 822 - protein, 11 aa, Artificial Sequence [sequence omitted]

SEQ ID NO: 823 - protein, 11 aa, Artificial Sequence [sequence omitted]

SEQ ID NO: 824 - protein, 11 aa, Artificial Sequence [sequence omitted]

SEQ ID NO: 825 - protein, 10 aa, Artificial Sequence [sequence omitted]

SEQ ID NO: 826 - protein, 11 aa, Artificial Sequence
  NK77.12_CD70_DB02_A06_CDR-L3
CQQSYSTPPTF

SEQ ID NO: 827 - protein, 11 aa, Artificial Sequence [sequence omitted]

SEQ ID NO: 828 - protein, 11 aa, Artificial Sequence [sequence omitted]

SEQ ID NO: 829 - protein, 11 aa, Artificial Sequence [sequence omitted]

SEQ ID NO: 830 - protein, 11 aa, Artificial Sequence [sequence omitted]

SEQ ID NO: 831 - protein, 11 aa, Artificial Sequence [sequence omitted]

SEQ ID NO: 832 - protein, 11 aa, Artificial Sequence [sequence omitted]

SEQ ID NO: 833 - protein, 11 aa, Artificial Sequence [sequence omitted]

SEQ ID NO: 834 - protein, 11 aa, Artificial Sequence [sequence omitted]

SEQ ID NO: 835 - protein, 11 aa, Artificial Sequence [sequence omitted]

SEQ ID NO: 836 - protein, 11 aa, Artificial Sequence [sequence omitted]

SEQ ID NO: 837 - protein, 11 aa, Artificial Sequence [sequence omitted]

SEQ ID NO: 838 - protein, 11 aa, Artificial Sequence [sequence omitted]

SEQ ID NO: 839 - protein, 11 aa, Artificial Sequence [sequence omitted]

SEQ ID NO: 840 - protein, 11 aa, Artificial Sequence [sequence omitted]

SEQ ID NO: 841 - protein, 11 aa, Artificial Sequence [sequence omitted]

SEQ ID NO: 842 - protein, 11 aa, Artificial Sequence [sequence omitted]

SEQ ID NO: 843 - protein, 11 aa, Artificial Sequence [sequence omitted]

SEQ ID NO: 844 - protein, 11 aa, Artificial Sequence [sequence omitted]

SEQ ID NO: 845 - protein, 11 aa, Artificial Sequence [sequence omitted]

SEQ ID NO: 846 - protein, 11 aa, Artificial Sequence [sequence omitted]

SEQ ID NO: 847 - protein, 11 aa, Artificial Sequence [sequence omitted]

SEQ ID NO: 848 - protein, 11 aa, Artificial Sequence
  NK77.37_CD70_DB03_A07_CDR-L3
CQQNFSPPLTF

SEQ ID NO: 849 - protein, 11 aa, Artificial Sequence
  NK77.38_CD70_DB03_A08_CDR-L3
CQQTYDAPITF

SEQ ID NO: 850 - protein, 11 aa, Artificial Sequence [sequence omitted]

SEQ ID NO: 851 - protein, 11 aa, Artificial Sequence [sequence omitted]

SEQ ID NO: 852 - protein, 11 aa, Artificial Sequence [sequence omitted]

SEQ ID NO: 853 - protein, 11 aa, Artificial Sequence [sequence omitted]

SEQ ID NO: 854 - protein, 11 aa, Artificial Sequence [sequence omitted]

SEQ ID NO: 855 - protein, 10 aa, Artificial Sequence [sequence omitted]

SEQ ID NO: 856 - protein, 11 aa, Artificial Sequence [sequence omitted]

SEQ ID NO: 857 - protein, 11 aa, Artificial Sequence
  NK77.46_CD70_DB03_C05_CDR-L3
CQQSYSTPPTF

SEQ ID NO: 858 - protein, 11 aa, Artificial Sequence
  NK77.47_CD70_DB03_D11_CDR-L3
CQQYYGFPPTF

SEQ ID NO: 859 - protein, 11 aa, Artificial Sequence
  NK77.48_CD70_DB03_E01_CDR-L3
CQQTYSFPFTF

SEQ ID NO: 860 - protein, 11 aa, Artificial Sequence [sequence omitted]

SEQ ID NO: 861 - protein, 11 aa, Artificial Sequence
  NK77.50_CD70_DB03_E09_CDR-L3
CMQTLESPVTF

SEQ ID NO: 862 - protein, 11 aa, Artificial Sequence
  NK77.51_CD70_DB03_F02_CDR-L3
CQQSYDGPITF

SEQ ID NO: 863 - protein, 11 aa, Artificial Sequence [sequence omitted]

SEQ ID NO: 864 - protein, 11 aa, Artificial Sequence [sequence omitted]

SEQ ID NO: 865 - protein, 11 aa, Artificial Sequence [sequence omitted]

SEQ ID NO: 866 - protein, 11 aa, Artificial Sequence [sequence omitted]

SEQ ID NO: 867 - protein, 11 aa, Artificial Sequence [sequence omitted]

SEQ ID NO: 868 - protein, 11 aa, Artificial Sequence [sequence omitted]

SEQ ID NO: 869 - protein, 11 aa, Artificial Sequence [sequence omitted]

SEQ ID NO: 870 - protein, 11 aa, Artificial Sequence [sequence omitted]

SEQ ID NO: 871 - protein, 11 aa, Artificial Sequence [sequence omitted]

SEQ ID NO: 872 - protein, 11 aa, Artificial Sequence [sequence omitted]

SEQ ID NO: 873 - protein, 11 aa, Artificial Sequence
  NK77.62_CD70_DB04_A10_CDR-L3
CMQALDTPLTF

SEQ ID NO: 874 - protein, 11 aa, Artificial Sequence
  NK77.63_CD70_DB04_A11_CDR-L3
LSTDLQTTAHF

SEQ ID NO: 875 - protein, 11 aa, Artificial Sequence [sequence omitted]

SEQ ID NO: 876 - protein, 11 aa, Artificial Sequence
  NK77.65_CD70_DB04_B05_CDR-L3
CQQADSFPVTF

SEQ ID NO: 877 - protein, 11 aa, Artificial Sequence
  NK77.66_CD70_DB04_B07_CDR-L3
CQQSYDGPMTF

SEQ ID NO: 878 - protein, 11 aa, Artificial Sequence [sequence omitted]

SEQ ID NO: 879 - protein, 11 aa, Artificial Sequence
  NK77.68_CD70_DB04_C04_CDR-L3
CQQSYDGPITF

SEQ ID NO: 880 - protein, 11 aa, Artificial Sequence [sequence omitted]

SEQ ID NO: 881 - protein, 11 aa, Artificial Sequence
  NK77.70_CD70_DB04_C07_CDR-L3
CLQDAATPITF

SEQ ID NO: 882 - protein, 11 aa, Artificial Sequence [sequence omitted]

SEQ ID NO: 883 - protein, 11 aa, Artificial Sequence
  NK77.72_CD70_DB04_D05_CDR-L3
CMKGLQTPLTF

SEQ ID NO: 884 - protein, 11 aa, Artificial Sequence [sequence omitted]

SEQ ID NO: 885 - protein, 11 aa, Artificial Sequence [sequence omitted]

SEQ ID NO: 886 - protein, 11 aa, Artificial Sequence [sequence omitted]

SEQ ID NO: 887 - protein, 11 aa, Artificial Sequence [sequence omitted]

SEQ ID NO: 888 - protein, 11 aa, Artificial Sequence [sequence omitted]

SEQ ID NO: 889 - protein, 11 aa, Artificial Sequence [sequence omitted]

SEQ ID NO: 890 - protein, 118 aa, Artificial Sequence
  NK77.1_CD70_DB01_C03_VH
QVQLVQSGAEVKKPGASVKVSCKASGYTFTGHYLHWVRQAPGQGLEWMGWINPNSGGTNYAQKFQGRVTMTRDTSTSTVYMELSSLRSEDTAVYYCVRGSGWYDLDYWGQGTLVTVSS

SEQ ID NO: 891 - protein, 119 aa, Artificial Sequence
  NK77.2_CD70_DB01_D02_VH
QVQLVQSGAEVKKPGASVKVSCKASGYTFTNYYMHWVRQAPGQGLEWMGIINPSGGSTSYAQKFQGRVTMTRDTSTSTVYMELSSLRSEDTAVYYCARELGVAGYFDLWGRGTLVTVSS

SEQ ID NO: 892 - protein, 123 aa, Artificial Sequence
  NK77.3_CD70_DB01_E06_VH
QVQLVQSGAEVKKPGASVKVSCKASGYTFTGYYIHWVRQAPGQGLEWMGIINPSGGSTSYAQKFQGRVTMTRDTSTSTVYMELSSLRSEDTAVYYCARDLSGIDGYIGFFDYWGQGTLVTVSS

SEQ ID NO: 893 - protein, 119 aa, Artificial Sequence
  NK77.4_CD70_DB01_G04_VH
QVQLVQSGAEVKKPGASVKVSCKASGGTFRSHVISWVRQAPGQGLEWMGIIDPSGGSTSYAQRFQGRVTMTRDTSTSTVYMELSSLRSEDTAVYYCAKDYTGLLGMDVWGQGTTVTVSS

SEQ ID NO: 894 - protein, 119 aa, Artificial Sequence
  NK77.5_CD70_DB01_G05_VH
QVQLVQSGAEVKKPGASVKVSCKASGYTFIDYYIHWVRQAPGQGLEWMGWMNPNSGNTGYAQKFQGRVTMTRDTSTSTVYMELSSLRSEDTAVYYCARGLSGYDLDDYWGQGTLVTVSS

SEQ ID NO: 895 - protein, 118 aa, Artificial Sequence
  NK77.6_CD70_DB01_G07_VH
QVQLVQSGAEVKKPGASVKVSCKASGYTFTSYYMHWVRQAPGQGLEWMGWINPNSGGTKYAHKFQGRVTMTRDTSTSTVYMELSSLRSEDTAVYYCARGLSGYDFDYWGQGTTVTVSS

SEQ ID NO: 896 - protein, 119 aa, Artificial Sequence
  NK77.7_CD70_DB01_G11_VH
QVQLVQSGAEVKKPGASVKVSCKASGYTFTGYYMHWVRQAPGQGLEWMGWMNPNSGNTGYAQKFQGRVTMTRDTSTSTVYMELSSLRSEDTAVYYCARGTDVYGDFDYWGQGTLVTVSS

SEQ ID NO: 897 - protein, 126 aa, Artificial Sequence
  NK77.9_CD70_DB02_A03_VH
QVQLVQSGAEVKKPGSSVKVSCKASGYTFTENEMHWVRQAPGQGLEWMGGIIPIFGTANYAQKFQGRVTITADESTSTAYMELSSLRSEDTAVYYCAREGGTAMATGYYYYGMDVWGQGTTVTVSS

SEQ ID NO: 898 - protein, 119 aa, Artificial Sequence
  NK77.10_CD70_DB02_A04_VH
QVQLVQSGAEVKKPGASVKVSCKASGYTFTENEMHWVRQAPGQGLEWMGWINSNGGYTGYALKFQGRVTMTRDTSTSTVYMELSSLRSEDTAVYYCARASNYGGHFDYWGQGTLVTVSS

SEQ ID NO: 899 - protein, 120 aa, Artificial Sequence
  NK77.11_CD70_DB02_A05_VH
QVQLVQSGAEVKKPGASVKVSCKASGYTFTSYYMHWVRQAPGQGLEWMGIINPSGGSTIYAQKFQGRVTMTRDTSTSTVYMELSSLRSEDTAVYYCAKDMGAWAAGFDYWGQGTLVTVSS

SEQ ID NO: 900 - protein, 120 aa, Artificial Sequence
  NK77.12_CD70_DB02_A06_VH
QVQLVQSGAEVKKPGASVKVSCKASGYTFTGYYMHWVRQAPGQGLEWMGWINPNSGDTGYAQKFQGRVTMTRDTSTSTVYMELSSLRSEDTAVYYCARSVNDYGDYDGYWGQGTLVTVSS

SEQ ID NO: 901 - protein, 120 aa, Artificial Sequence
  NK77.13_CD70_DB02_A07_VH
QVQLVQSGAEVKKPGASVKVSCKASGYTFTGYYMHWVRQAPGQGLEWMGIINPSGGSTSYAQKFQGRVTMTRDTSTSTVYMELSSLRSEDTAVYYCARDYGDYDASFDYWGQGTLVTVSS

SEQ ID NO: 902 - protein, 117 aa, Artificial Sequence
  NK77.14_CD70_DB02_A08_VH
QVQLVQSGAEVKKPGASVKVSCKASGYTFTSYDINWVRQAPGQGLEWMGIINPSDGSTIYAQNFQGRVTMTRDTSTSTVYMELSSLRSEDTAVYYCVKEEAWYFDLWGRGTLVTVSS

SEQ ID NO: 903 - protein, 117 aa, Artificial Sequence
  NK77.15_CD70_DB02_A09_VH
QVQLVQSGAEVKKPGASVKVSCKASGYTFTSYYMHWVRQAPGQGLEWMGWMNPDNGDTGYAQMFQGRVTMTRDTSTSTVYMELSSLRSEDTAVYYCASGDYYDILYWGQGTLVTVSS

SEQ ID NO: 904 - protein, 118 aa, Artificial Sequence
  NK77.16_CD70_DB02_A11_VH
QVQLVQSGAEVKKPGASVKVSCKASGYTFTSYYMHWVRQAPGQGLEWMGWMNPNSGDTGYAQKFQGRVTMTRDTSTSTVYMELSSLRSEDTAVYYCARGPSGYEFDYWGQGTLVTVSS

SEQ ID NO: 905 - protein, 122 aa, Artificial Sequence
  NK77.17_CD70_DB02_B06_VH
QVQLVQSGAEVKKPGASVKVSCKASGYTFTDYYMHWVRQAPGQGLEWMGIINPNSGGTNYAQKFQGRVTMTRDTSTSTVYMELSSLRSEDTAVYYCARDFSVYAAADGMDVWGQGTLVTVSS

SEQ ID NO: 906 - protein, 121 aa, Artificial Sequence
  NK77.18_CD70_DB02_B09_VH
QVQLVQSGAEVKKPGASVKVSCKASGYTFTGYYMHWVRQAPGQGLEWMGIINPGDGGTIYAQNFQGRVTMTRDTSTSTVYMELSSLRSEDTAVYYCARGFGESAPDAFDIWGQGTMVTVSS

SEQ ID NO: 907 - protein, 118 aa, Artificial Sequence
  NK77.19_CD70_DB02_C03_VH
QVQLVQSGAEVKKPGASVKVSCKASGYTFTGYYMHWVRQAPGQGLEWMGIINPSGGSTSYAQKFQGRVTMTRDTSTSTVYMELSSLRSEDTAVYYCAAGTEIYYMDVWGKGTTVTVSS

SEQ ID NO: 908 - protein, 127 aa, Artificial Sequence
  NK77.20_CD70_DB02_C04_VH
QVQLVQSGAEVKKPGASVKVSCKASGGTFSSYAISWVRQAPGQGLEWMGMINPSDGATTYAQKFQGRVTMTRDTSTSTVYMELSSLRSEDTAVYYCARERELLHFATNYYYYGMDVWGQGTTVTVSS

SEQ ID NO: 909 - protein, 123 aa, Artificial Sequence
  NK77.22_CD70_DB02_C07_VH
QVQLVQSGAEVKKPGASVKVSCKASGYTFTRNYMHWVRQAPGQGLEWMGWISPDNGVTNYAQNFQGRVTMTRDTSTSTVYMELSSLRSEDTAVYYCAKTQGSSSWYQWYFDLWGRGTLVTVSS

SEQ ID NO: 910 - protein, 119 aa, Artificial Sequence
  NK77.24_CD70_DB02_D02_VH
QVQLVQSGAEVKKPGASVKVSCKASGYTFTSYYMHWVRQAPGQGLEWMGIIDPGSGDTSYAQKFQGRVTMTRDTSTSTVYMELSSLRSEDTAVYYCARGSNWYDYFDYWGQGTLVTVSS

SEQ ID NO: 911 - protein, 119 aa, Artificial Sequence
  NK77.25_CD70_DB02_D04_VH
QVQLVQSGAEVKKPGASVKVSCKASGYRLSDHYMHWVRQAPGQGLEWMGIINPSGGSTTYAQNFQGRVTMTRDTSTSTVYMELSSLRSEDTAVYYCASSYYGDYVLVNWGQGTLVTVSS

SEQ ID NO: 912 - protein, 120 aa, Artificial Sequence
  NK77.26_CD70_DB02_D10_VH
QVQLVQSGAEVKKPGASVKVSCKASGYTFTDYYVHWVRQAPGQGLEWMGWINPNTGGTSFAQNFQGRVTMTRDTSTSTVYMELSSLRSEDTAVYYCARDLGQWLGEIDYWGQGTLVTVSS

SEQ ID NO: 913 - protein, 124 aa, Artificial Sequence
  NK77.27_CD70_DB02_D11_VH
QVQLVQSGAEVKKPGASVKVSCKASGYTFTDYTDYFVHWVRQAPGQGLEWMGIFNPSDGSTSYAQEFQGRVTMTRDTSTSTVYMELSSLRSEDTAVYYCARGPYSSSWYYFDYWGQGTLVTVSS

SEQ ID NO: 914 - protein, 120 aa, Artificial Sequence
  NK77.28_CD70_DB02_E04_VH
QVQLVQSGAEVKKPGASVKVSCKASGYIFTDYYMHWVRQAPGQGLEWMGIINPSGGDTLYAQKFQGRVTMTRDTSTSTVYMELSSLRSEDTAVYYCAREGVGAMGVFDYWGQGTLVTVSS

SEQ ID NO: 915 - protein, 122 aa, Artificial Sequence
  NK77.29_CD70_DB02_F06_VH
QVQLVQSGAEVKKPGASVKVSCKASGYTFTDHYIHWVRQAPGQGLEWMGWISAYNGKTNYAQKFQGRVTMTRDTSTSTVYMELSSLRSEDTAVYYCARDTIYYDFWSGYDYWGQGTLVTVSS

SEQ ID NO: 916 - protein, 122 aa, Artificial Sequence
  NK77.31_CD70_DB02_F08_VH
QVQLVQSGAEVKKPGASVKVSCKASGYTFTSYYMHWVRQAPGQGLEWMGIINPSGGATIYAQKFQGRVTMTRDTSTSTVYMELSSLRSEDTAVYYCARSRGDYYGSGDFDYWGQGTLVTVSS

SEQ ID NO: 917 - protein, 118 aa, Artificial Sequence
  NK77.32_CD70_DB02_G07_VH
QVQLVQSGAEVKKPGASVKVSCKASGYTFTDYYMHWVRQAPGQGLEWMGIINPSGGSTSYAQKFQGRVTMTRDTSTSTVYMELSSLRSEDTAVYYCARGYFDHAFDIWGQGTMVTVSS

SEQ ID NO: 918 - protein, 124 aa, Artificial Sequence
  NK77.33_CD70_DB02_H04_VH
QVQLVQSGAEVKKPGASVKVSCKASGYTFTGYYMHWVRQAPGQGLEWMGIINPSGGDTIYAQKFQGRVTMTRDTSTSTVYMELSSLRSEDTAVYYCARGDSSSWYDYYYYMDVWGKGTTVTVSS

SEQ ID NO: 919 - protein, 119 aa, Artificial Sequence
  NK77.34_CD70_DB02_H05_VH
QVQLVQSGAEVKKPGASVKVSCKASGYTFTDYFTHWVRQAPGQGLEWMGWINTYDGNTNYAQKFQGRVTMTRDTSTSTVYMELSSLRSEDTAVYYCAREMEWLGQVDYWGQGTLVTVSS

SEQ ID NO: 920 - protein, 119 aa, Artificial Sequence
  NK77.35_CD70_DB02_H08_VH
QVQLVQSGAEVKKPGASVKVSCKASGYTFTSYYIHWVRQAPGQGLEWMGRINPNGGGTNYAQKFQGRVTMTRDTSTSTVYMELSSLRSEDTAVYYCARGHRGGGGIDYWGQGTLVTVSS

SEQ ID NO: 921 - protein, 119 aa, Artificial Sequence
  NK77.36_CD70_DB03_A06_VH
QVQLVQSGAEVKKPGASVKVSCKASGGTFSSYAISWVRQAPGQGLEWMGWISPNSGDTHYAQKFQGRVTMTRDTSTSTVYMELSSLRSEDTAVYYCARDWGSGWYVDYWGQGTLVTVSS

SEQ ID NO: 922 - protein, 119 aa, Artificial Sequence
  NK77.37_CD70_DB03_A07_VH
QVQLVQSGAEVKKPGSSVKVSCKASGGTFNSYGISWVRQAPGQGLEWMGGIIPIFGTANYAQKFQGRVTITADESTSTAYMELSSLRSEDTAVYYCARDTYGDDAFDIWGQGTMVTVSS

SEQ ID NO: 923 - protein, 124 aa, Artificial Sequence
  NK77.38_CD70_DB03_A08_VH
QVQLVQSGAEVKKPGASVKVSCKASGYSFTSYYMHWVRQAPGQGLEWMGIINPSGGTTSYAQKFQGRVTMTRDTSTSTVYMELSSLRSEDTAVYYCARDNSPYSSSWWDYFDYWGQGTLVTVSS

SEQ ID NO: 924 - protein, 122 aa, Artificial Sequence
  NK77.39_CD70_DB03_A09_VH
QVQLVQSGAEVKKPGASVKVSCKASGYTFTDYYIHWVRQAPGQGLEWMGWITPNSGYTYYAQNFQGRVTMTRDTSTSTVYMELSSLRSEDTAVYYCARNTDCYGDFLGLDVWGQGTTVTVSS

SEQ ID NO: 925 - protein, 122 aa, Artificial Sequence
  NK77.40_CD70_DB03_A11_VH
QVQLVQSGAEVKKPGASVKVSCKASGYTFNGYLMHWVRQAPGQGLEWMGIVNPSDGSTGYAQKFQGRVTMTRDTSTSTVYMELSSLRSEDTAVYYCAKDTGLRYFDWLLDYWGQGTLVTVSS

SEQ ID NO: 926 - protein, 118 aa, Artificial Sequence
  NK77.41_CD70_DB03_A12_VH
QVQLVQSGAEVKKPGASVKVSCKASGYTFTSYYMHWVRQAPGQGLEWMGIIDPSGGRTIYAQRFQGRVTMTRDTSTSTVYMELSSLRSEDTAVYYCARHEAGGIFDYWGQGTLVTVSS

SEQ ID NO: 927 - protein, 121 aa, Artificial Sequence
  NK77.42_CD70_DB03_B01_VH
QVQLVQSGAEVKKPGSSVKVSCKASGYTFSDSYMHWVRQAPGQGLEWVGGIIPMAGIPAYAEEFQGRVTITADESTSTAYMELSSLRSEDTAVYYCARADDYGGNWYFDLWGRGTLVTVSS

SEQ ID NO: 928 - protein, 120 aa, Artificial Sequence
  NK77.43_CD70_DB03_B04_VH
QVQLVQSGAEVKKPGASVKVSCKASGYIFTDYYMHWVRQAPGQGLEWMGIINPSGGSTSYAQKFQGRVTMTRDTSTSTVYMELSSLRSEDTAVYYCARDSGWYESWFDPWGQGTLVTVSS

SEQ ID NO: 929 - protein, 122 aa, Artificial Sequence
  NK77.44_CD70_DB03_B06_VH
QVQLVQSGAEVKKPGASVKVSCKASGYTFTDYYLHWVRQAPGQGLEWMGWISAYNGNTNYAQKFQGRVTMTRDTSTSTVYMELSSLRSEDTAVYYCAREIVGATEDWYFDLWGRGTLVTVSS

SEQ ID NO: 930 - protein, 119 aa, Artificial Sequence
  NK77.45_CD70_DB03_B09_VH
QVQLVQSGAEVKKPGASVKVSCKASGYTFTAYYLHWVRQAPGQGLEWMGMINPNNGGTIYAQTFQGRVTMTRDTSTSTVYMELSSLRSEDTAVYYCARDLGGYVLFDYWGQGTLVTVSS

SEQ ID NO: 931 - protein, 119 aa, Artificial Sequence
  NK77.46_CD70_DB03_C05_VH
QVQLVQSGAEVKKPGASVKVSCKASGYTFTDYYIHWVRQAPGQGLEWMGMINPRGGSTTYAQSFQGRVTMTRDTSTSTVYMELSSLRSEDTAVYYCARDLGDYGDYDYWGQGTLVTVSS

SEQ ID NO: 932 - protein, 124 aa, Artificial Sequence
  NK77.47_CD70_DB03_D11_VH
EVQLLESGGGLVQPGGSLRLSCAASGFTFSNSDMNWVRQAPGKGLEWVSAISGGGDTLYYADSVKGRFTISRDNSKNTLYLQMNSLRAEDTAVYYCAMASALDSSGDNEAFDIWGQGTTVTVSS

SEQ ID NO: 933 - protein, 122 aa, Artificial Sequence
  NK77.48_CD70_DB03_E01_VH
QVQLVQSGAEVKKPGASVKVSCKASGYTFTSYYMHWVRQAPGQGLEWMGWINPNNGGTSYAQKFQGRVTMTRDTSTSTVYMELSSLRSEDTAVYYCARVEDDFWSGPSFDYWGQGTLVTVSS

SEQ ID NO: 934 - protein, 119 aa, Artificial Sequence
  NK77.49_CD70_DB03_E03_VH
QVQLVQSGAEVKKPGSSVKVSCKASGGTFTNYAFSWVRQAPGQGLEWMGGIIPISGAANYAQKFQGRVTITADESTSTAYMELSSLRSEDTAVYYCARGSGLDDAFDIWGQGTMVTVSS

SEQ ID NO: 935 - protein, 129 aa, Artificial Sequence
  NK77.50_CD70_DB03_E09_VH
QVQLVQSGAEVKKPGASVKVSCKASGYTFTAYYMHWVRQAPGQGLEWMGWMNPNSGNTGYAQKFQGRVTMTRDTSTSTVYMELSSLRSEDTAVYYCAREGRIDYGDYDDYYYYYGMDVWGQGTTVTVSS

SEQ ID NO: 936 - protein, 120 aa, Artificial Sequence
  NK77.51_CD70_DB03_F02_VH
QVQLVQSGAEVKKPGASVKVSCKASGYTFTDYYVHWVRQAPGQGLEWMGTINPSGGSTSYAQKFQGRVTMTRDTSTSTVYMELSSLRSEDTAVYYCARDQGLWFTGFDYWGQGTLVTVSS

SEQ ID NO: 937 - protein, 120 aa, Artificial Sequence
  NK77.52_CD70_DB03_F05_VH
QVQLVQSGAEVKKPGASVKVSCKASGYTFTAYHMHWVRQAPGQGLEWMGIINPGDGATGYAQNLQGRVTMTRDTSTSTVYMELSSLRSEDTAVYYCAGEGISGSDAFDIWGQGTLVTVSS

SEQ ID NO: 938 - protein, 118 aa, Artificial Sequence
  NK77.53_CD70_DB03_F06_VH
QVQLVQSGAEVKKPGSSVKVSCKASGGTFSSYAISWVRQAPGQGLEWMGWMNPNSGNTGYAQKFQGRVTITADESTSTAYMELSSLRSEDTAVYYCAWGVDPYYFDYWGQGTLVTVSS

SEQ ID NO: 939 - protein, 118 aa, Artificial Sequence
  NK77.54_CD70_DB03_F09_VH
QVQLVQSGAEVKKPGASVKVSCKASGYTFTSYYMHWVRQAPGQGLEWMGIFNPSDGSTSYAQKFQGRVTMTRDTSTSTVYMELSSLRSEDTAVYYCARDVGETTFDPWGQGTLVTVSS

SEQ ID NO: 940 - protein, 123 aa, Artificial Sequence
  NK77.55_CD70_DB03_F12_VH
QVQLVQSGAEVKKPGASVKVSCKASGYTFTSYGISWVRQAPGQGLEWMGWISAYNGHTNYAQKFQGRVTMTRDTSTSTVYMELSSLRSEDTAVYYCARDSVRGWDYYYGMGVWGQGTTVTVSS

SEQ ID NO: 941 - protein, 120 aa, Artificial Sequence
  NK77.56_CD70_DB03_G06_VH
QVQLVQSGAEVKKPGSSVKVSCKASGYTFIDYYMHWVRQAPGQGLEWMGWMNPHSGNSDNAPKFQGRVTITADESTSTAYMELSSLRSEDTAVYYCARGYSGYDLTADYWGQGTLVTVSS

SEQ ID NO: 942 - protein, 129 aa, Artificial Sequence
  NK77.57_CD70_DB03_G11_VH
QVQLVQSGAEVKKPGASVKVSCKASGYTFTGQYMHWVRQAPGQGLEWMGWINPNTGDTNYAQKFQGRVTMTRDTSTSTVYMELSSLRSEDTAVYYCARDSVFEVEGGTDYYYYYGMDVWGQGTMVTVSS

SEQ ID NO: 943 - protein, 119 aa, Artificial Sequence
  NK77.58_CD70_DB03_H08_VH
QVQLVQSGAEVKKPGASVKVSCKASGYTFTSYDINWVRQAPGQGLEWMGVINPSGGGTSYAQKFQGRVTMTRDTSTSTVYMELSSLRSEDTAVYYCARYSGYDWVFDYWGQGTLVTVSS

SEQ ID NO: 944 - protein, 120 aa, Artificial Sequence
  NK77.59_CD70_DB03_H10_VH
QVQLVQSGAEVKKPGASVKVSCKASGYTFANYYMHWVRQAPGQGLEWMGIINPSGGSTSYAQKFQGRVTMTRDTSTSTVYMELSSLRSEDTAVYYCARDSGSYFGWFDPWGQGTLVTVSS

SEQ ID NO: 945 - protein, 120 aa, Artificial Sequence
  NK77.60_CD70_DB04_A05_VH
QVQLVQSGAEVKKPGASVKVSCKASGYTFTTYYMHWVRQAPGQGLEWMGIINPTGGSTYYAQKFQGRVTMTRDTSTSTVYMELSSLRSEDTAVYYCARDSGNYQGIFDYWGQGTLVTVSS

SEQ ID NO: 946 - protein, 119 aa, Artificial Sequence
  NK77.61_CD70_DB04_A07_VH
QVQLVQSGAEVKKPGASVKVSCKASGNTFTSYYMHWVRQAPGQGLEWMGWINPNSGDTNYAQNFQGRVTMTRDTSTSTVYMELSSLRSEDTAVYYCARGVSGYDLFDYWGQGTLVTVSS

SEQ ID NO: 947 - protein, 114 aa, Artificial Sequence
  NK77.62_CD70_DB04_A10_VH
EVQLVESGGGLVKPGGSLRLSCAASGFTFSSYGMHWVRQAPGKGLEWVASIKHDGSEQYYVDSVKGRFTISRDDSKNTLYLQMNSLKTEDTAVYYCAASGVDVWGQGTTVTVSS

SEQ ID NO: 948 - protein, 122 aa, Artificial Sequence
  NK77.63_CD70_DB04_A11_VH
QVQLVQSGAEVKKPGASVKVSCKASGGTFSRYDINWVRQAPGQGLEWVGIIDPTGASTSYAQKFQGRVTMTRDTSTSTVYMELSSLRSEDTAVYYCARDYSYGMDYYGMDVWGQGTLVTVSS

SEQ ID NO: 949 - protein, 119 aa, Artificial Sequence
  NK77.64_CD70_DB04_B03_VH
QVQLVQSGAEVKKPGSSVKVSCKASGYTFTSYGISWVRQAPGQGLEWMGGIIPIFGTTNYAQKFQGRVTITADESTSTAYMELSSLRSEDTAVYYCARDHSGDGYFDLWGRGTLVTVSS

SEQ ID NO: 950 - protein, 118 aa, Artificial Sequence
  NK77.65_CD70_DB04_B05_VH
QVQLVQSGAEVKKPGASVKVSCKASGYTFTENEMHWVRQAPGQGLEWMGWINPNSGGTNYAQKFQGRVTMTRDTSTSTVYMELSSLRSEDTAVYYCAGSWGGYYFDYWGQGTLVTVSS

SEQ ID NO: 951 - protein, 121 aa, Artificial Sequence
  NK77.66_CD70_DB04_B07_VH
QVQLVQSGAEVKKPGASVKVSCKASGYTFTNYYIYWVRQAPGQGLEWMGWINPNDGATNYAQKFQGRVTMTRDTSTSTVYMELSSLRSEDTAVYYCAREGNDYYYYFMDYWGQGTLVTVSS

SEQ ID NO: 952 - protein, 122 aa, Artificial Sequence
  NK77.67_CD70_DB04_C01_VH
QVQLVQSGAEVKKPGSSVKVSCKASGGTFSSYAISWVRQAPGQGLEWMGGITPMFGTTDYAQKFQGRVTITADESTSTAYMELSSLRSEDTAVYYCARDERDGYATVAFDIWGQGTMVTVSS

SEQ ID NO: 953 - protein, 122 aa, Artificial Sequence
  NK77.68_CD70_DB04_C04_VH
QVQLVQSGAEVKKPGASVKVSCKASGYTFTSYYMHWVRQAPGQGLEWMGIINPSDGGTSYADKFQGRVTMTRDTSTSTVYMELSSLRSEDTAVYYCARALAPLGWGDGMDVWGQGTTVTVSS

SEQ ID NO: 954 - protein, 119 aa, Artificial Sequence
  NK77.69_CD70_DB04_C06_VH
QVQLVQSGAEVKKPGSSVKVSCKASGYTFTSYYIHWVRQAPGQGLEWMGWMNPSSGVTNFAQKFQGRVTITADESTSTAYMELSSLRSEDTAVYYCARGSDQGDWSDPWGQGTLVTVSS

SEQ ID NO: 955 - protein, 122 aa, Artificial Sequence
  NK77.70_CD70_DB04_C07_VH
QVQLVQSGAEVKKPGASVKVSCKASGYTFTDSYIHWVRQAPGQGLEWIGWMNPNTGDTGYAQKFQGRVTMTRDTSTSTVYMELSSLRSEDTAVYYCAKDDFGELAPATFDPWGQGTLVTVSS

SEQ ID NO: 956 - protein, 122 aa, Artificial Sequence
  NK77.71_CD70_DB04_D02_VH
QVQLVQSGAEVKKPGASVKVSCKASGYTFTSYDINWVRQAPGQGLEWMGVISPSGGGTSYAQKFQGRVTMTRDTSTSTVYMELSSLRSEDTAVYYCARYYGGNPEGWYFDLWGRGTLVTVSS

SEQ ID NO: 957 - protein, 132 aa, Artificial Sequence
  NK77.72_CD70_DB04_D05_VH
EVQLLESGGGLVQPGGSLRLSCAASGFVFDDYAIHWVRQAPGKGLEWVAAISYDGSNKYYADSVKGRFTISRDNSKNTLYLQMNSLRAEDTAVYYCARAPQYYGSGTDPLEVRYYYYGMDVWGQGTTVTVSS

SEQ ID NO: 958 - protein, 122 aa, Artificial Sequence
  NK77.73_CD70_DB04_D07_VH
QVQLVQSGAEVKKPGSSVKVSCKASGGTFRNYAISWVRQAPGQGLEWMGGIIPIFGTANYAQKFQGRVTITADESTSTAYMELSSLRSEDTAVYYCARDHSAGTHHDAFDIWGQGTMVTVSS

SEQ ID NO: 959 - protein, 117 aa, Artificial Sequence
  NK77.74_CD70_DB04_D08_VH
QVQLVQSGAEVKKPGASVKVSCKASGYTFTSYYIHWVRQAPGQGLEWMGWMNPNSGNAGYAQKFQGRVTMTRDTSTSTVYMELSSLRSEDTAVYYCAREYWGSFDYWGQGTLVTVSS

SEQ ID NO: 960 - protein, 118 aa, Artificial Sequence
  NK77.75_CD70_DB04_D10_VH
QVQLVQSGAEVKKPGASVKVSCKASGYTFTGYYMHWVRQAPGQGLEWMGMIDPSDGSTIYAQKFQGRVTMTRDTSTSTVYMELSSLRSEDTAVYYCARERPLYASDLWGQGTLVTVSS

SEQ ID NO: 961 - protein, 119 aa, Artificial Sequence
  NK77.85_CD70_DB03_B02_VH
QVQLVQSGAEVKKPGSSVKVSCKASGYTFTNYYMHWVRQAPGQGLEWMGWMNPDSGNTGYAQKFQGRVTITADESTSTAYMELSSLRSEDTAVYYCARSSSSWPDFDLWGRGTLVTVSS

SEQ ID NO: 962 - protein, 120 aa, Artificial Sequence
  NK77.86_CD70_DB04_A06_VH
QVQLVQSGAEVKKPGASVKVSCKASGYTFTSYSMHWVRQAPGQGLEWVGIINPSSGSASYAQKFQGRVTMTRDTSTSTVYMELSSLRSEDTAVYYCARERGAYSSTFDYWGQGTLVTVSS

SEQ ID NO: 963 - protein, 120 aa, Artificial Sequence
  NK77.87_CD70_DB04_A09_VH
QVQLVQSGAEVKKPGASVKVSCKASGYTFTDYYMHWVRQAPGQGLEWMGVINPSDGTAHYAQRLQGRVTMTRDTSTSTVYMELSSLRSEDTAVYYCARDSGSYYADFDYWGQGTLVTVSS

SEQ ID NO: 964 - protein, 108 aa, Artificial Sequence
  NK77.1_CD70_DB01_C03_VL
DIQMTQSPSSLSASVGDRVTITCRASQNIGTYLAWYQQKPGKAPKLLIYDASNLETGVPSRFSGSGSGTDFTLTISSLQPEDFATYYCQQSYRIPLTFGQGTRLEIKR

SEQ ID NO: 965 - protein, 108 aa, Artificial Sequence
  NK77.2_CD70_DB01_D02_VL
DIQMTQSPSSLSASVGDRVTITCRASQRISNWLAWYQQKPGKAPKLLIYDASNLETGVPSRFSGSGSGTDFTLTISSLQPEDFATYYCQQTYSPPPTFGQGTKLEIKR

SEQ ID NO: 966 - protein, 113 aa, Artificial Sequence
  NK77.3_CD70_DB01_E06_VL
DIVMTQSPLSLPVTPGEPASISCRSSQSLLHSNGYNYLDWYLQKPGQSPQLLIYAASSLQSGVPDRFSGSGSGTDFTLKISRVEAEDVGVYYCMQALQTPITFGQGTRLEIKR

SEQ ID NO: 967 - protein, 108 aa, Artificial Sequence
  NK77.4_CD70_DB01_G04_VL
DIQMTQSPSSLSASVGDRVTITCRASQDIDTYLAWYQQKPGKAPKLLIYAASSLQSGVPSRFSGSGSGTDFTLTISSLQPEDFATYYCQQSYTTPFTFGQGTKVEIKR

SEQ ID NO: 968 - protein, 108 aa, Artificial Sequence
  NK77.5_CD70_DB01_G05_VL
DIQMTQSPSSLSASVGDRVTITCQASQDISNYLNWYQQKPGKAPKLLIYDASSLESGVPSRFSGSGSGTDFTLTISSLQPEDFATYYCQQSYRSPLTFGGGTKVEIKR

SEQ ID NO: 969 - protein, 108 aa, Artificial Sequence
  NK77.6_CD70_DB01_G07_VL
DIQMTQSPSSLSASVGDRVTITCQASQDISNYLNWYQQKPGKAPKLLIYDASNLETGVPSRFSGSGSGTDFTLTISSLQPEDFATYYCQQAYRWPITFGQGTRLEIKR

SEQ ID NO: 970 - protein, 108 aa, Artificial Sequence
  NK77.7_CD70_DB01_G11_VL
DIQMTQSPSSLSASVGDRVTITCRASQSISSYLNWYQQKPGKAPKLLIYDASYLETGVPSRFSGSGSGTDFTLTISSLQPEDFATYYCQQSYTIPPTFGQGTKVEIKR

SEQ ID NO: 971 - protein, 108 aa, Artificial Sequence
  NK77.9_CD70_DB02_A03_VL
DIQMTQSPSSLSASVGDRVTITCQASQDISNYLNWYQQKPGKAPKLLIYDASNLETGVPSRFSGSGSGTDFTLTISSLQPEDFATYYCQQSYSTPLTFGQGTKVEIKR

SEQ ID NO: 972 - protein, 113 aa, Artificial Sequence
  NK77.10_CD70_DB02_A04_VL
DIVMTQSPLSLPVTPGEPASISCRSSQSLLHSNGYNYLDWYLQKPGQSPQLLIYQASSLESGVPDRFSGSGSGTDFTLKISRVEAEDVGVYYCMQGTHWPPTFGGGTKVEIKR

SEQ ID NO: 973 - protein, 107 aa, Artificial Sequence
  NK77.11_CD70_DB02_A05_VL
DIQMTQSPSSLSASVGDRVTITCQASQDISNYLNWYQQKPGKAPKLLIYATSTLANGVPSRFSGSGSGTDFTLTISSLQPEDFATYYCQQSYSTLTFGQGTRLEIKR

SEQ ID NO: 974 - protein, 108 aa, Artificial Sequence
  NK77.12_CD70_DB02_A06_VL
DIQMTQSPSSLSASVGDRVTITCQASQDISNYLNWYQQKPGKAPKLLIYDASNLETGVPSRFSGSGSGTDFTLTISSLQPEDFATYYCQQSYSTPPTFGQGTKVEIKR

SEQ ID NO: 975 - protein, 108 aa, Artificial Sequence
  NK77.13_CD70_DB02_A07_VL
DIQMTQSPSSLSASVGDRVTITCRASQSIDNWLAWYQQKPGKAPKLLIYAASTLQSGVPSRFSGSGSGTDFTLTISSLQPEDFATYYCQQSYDSPPTFGQGTKLEIKR

SEQ ID NO: 976 - protein, 108 aa, Artificial Sequence
  NK77.14_CD70_DB02_A08_VL
DIQMTQSPSSLSASVGDRVTITCQASQDISNYLNWYQQKPGKAPKLLIYDASNLETGVPSRFSGSGSGTDFTLTISSLQPEDFATYYCQQSYSTPLTFGGGTKVEIKR

SEQ ID NO: 977 - protein, 108 aa, Artificial Sequence
  NK77.15_CD70_DB02_A09_VL
DIQMTQSPSSLSASVGDRVTITCQASQDISNYLNWYQQKPGKAPKLLIYDVSNLETGVPSRFSGSGSGTDFTLTISSLQPEDFATYYCQQANSFPLTFGGGTKVEIKR

SEQ ID NO: 978 - protein, 108 aa, Artificial Sequence
  NK77.16_CD70_DB02_A11_VL
DIQMTQSPSSLSASVGDRVTITCRASQTISNYLNWYQQKPGKAPKLLIYDASSLESGVPSRFSGSGSGTDFTLTISSLQPEDFATYYCQQAISFPLTFGGGTKVEIKR

SEQ ID NO: 979 - protein, 108 aa, Artificial Sequence
  NK77.17_CD70_DB02_B06_VL
DIQMTQSPSSLSASVGDRVTITCRASQSISSYLNWYQQKPGKAPKLLIYDASNLATGVPSRFSGSGSGTDFTLTISSLQPEDFATYYCQQSDSSPLTFGQGTKVEIKR

SEQ ID NO: 980 - protein, 108 aa, Artificial Sequence
  NK77.18_CD70_DB02_B09_VL
DIQMTQSPSSLSASVGDRVTITCQASQDISNYLNWYQQKPGKAPKLLIYGATTLQSGVPSRFSGSGSGTDFTLTISSLQPEDFATYYCQQADSFPYTFGQGTKLEIKR

SEQ ID NO: 981 - protein, 108 aa, Artificial Sequence
  NK77.19_CD70_DB02_C03_VL
DIQMTQSPSSLSASVGDRVTITCRASQTIDIYLNWYQQKPGKAPKLLIYDASNLETGVPSRFSGSGSGTDFTLTISSLQPEDFATYYCQQADSFPLTFGGGTKVEIKR

SEQ ID NO: 982 - protein, 108 aa, Artificial Sequence
  NK77.20_CD70_DB02_C04_VL
DIQMTQSPSSLSASVGDRVTITCRASQGISNNLNWYQQKPGKAPKLLIYAASSLHSGVPSRFSGSGSGTDFTLTISSLQPEDFATYYCQQADAFPLTFGGGTKVEIKR

SEQ ID NO: 983 - protein, 108 aa, Artificial Sequence
  NK77.22_CD70_DB02_C07_VL
DIQMTQSPSSLSASVGDRVTITCRASQSIGTWLAWYQQKPGKAPKLLIYAASSLQSGVPSRFSGSGSGTDFTLTISSLQPEDFATYYCQQSYTTPITFGQGTKVEIKR

SEQ ID NO: 984 - protein, 108 aa, Artificial Sequence
  NK77.24_CD70_DB02_D02_VL
EIVMTQSPATLSVSPGERATLSCRASQSVSSYLAWYQQKPGQAPRLLIYGASTRATGIPARFSGSGSGTEFTLTISSLQSEDFAVYYCQQYDSYPPTFGGGTKVEIKR

SEQ ID NO: 985 - protein, 108 aa, Artificial Sequence
  NK77.25_CD70_DB02_D04_VL
DIQMTQSPSSLSASVGDRVTITCQASQDISNYLNWYQQKPGKAPKLLIYAASTLESGVPSRFSGSGSGTDFTLTISSLQPEDFATYYCLQDYDYPLTFGQGTKLEIKR

SEQ ID NO: 986 - protein, 108 aa, Artificial Sequence
  NK77.26_CD70_DB02_D10_VL
DIQMTQSPSSLSASVGDRVTITCRASQTIYKWLAWYQQKPGKAPKLLIYDASSLESGVPSRFSGSGSGTDFTLTISSLQPEDFATYYCQQANSFPFTFGPGTKVDIKR

SEQ ID NO: 987 - protein, 108 aa, Artificial Sequence
  NK77.27_CD70_DB02_D11_VL
DIQMTQSPSSLSASVGDRVTITCQASQDISNYLNWYQQKPGKAPKLLIYDASNLETGVPSRFSGSGSGTDFTLTISSLQPEDFATYYCQQAHSFPPTFGQGTKVEIKR

SEQ ID NO: 988 - protein, 108 aa, Artificial Sequence
  NK77.28_CD70_DB02_E04_VL
DIQMTQSPSSLSASVGDRVTITCRASTSISDYVHWYQQKPGKAPKLLIYDASSLQSGVPSRFSGSGSGTDFTLTISSLQPEDFATYYCQQSDSTPPTFGGGTKVEIKR

SEQ ID NO: 989 - protein, 108 aa, Artificial Sequence
  NK77.29_CD70_DB02_F06_VL
DIQMTQSPSSLSASVGDRVTITCRASQGISNNLNWYQQKPGKAPKLLIYYASTLQSGVPSRFSGSGSGTDFTLTISSLQPEDFATYYCQQSYSTPITFGQGTRLEIKR

SEQ ID NO: 990 - protein, 108 aa, Artificial Sequence
  NK77.31_CD70_DB02_F08_VL
DIQMTQSPSSLSASVGDRVTITCRASQTISNYLNWYQQKPGKAPKLLIYDASTLEAGVPSRFSGSGSGTDFTLTISSLQPEDFATYYCQQSYNPPYTFGQGTKLEIKR

SEQ ID NO: 991 - protein, 108 aa, Artificial Sequence
  NK77.32_CD70_DB02_G07_VL
DIQMTQSPSSLSASVGDRVTITCRASQSISTYLNWYQQKPGKAPKLLIYDASNLEIGVPSRFSGSGSGTDFTLTISSLQPEDFATYYCQQSDSSPLTFGQGTKVEIKR

SEQ ID NO: 992 - protein, 108 aa, Artificial Sequence
  NK77.33_CD70_DB02_H04_VL
DIQMTQSPSSLSASVGDRVTITCQASQDISNYLNWYQQKPGKAPKLLIYAASSLQSGVPSRFSGSGSGTDFTLTISSLQPEDFATYYCQQSYRTPLTFGGGTKVEIKR

SEQ ID NO: 993 - protein, 108 aa, Artificial Sequence
  NK77.34_CD70_DB02_H05_VL
DIQMTQSPSSLSASVGDRVTITCRASQDIRNDLGWYQQKPGKAPKLLIYAASNLETGVPSRFSGSGSGTDFTLTISSLQPEDFATYYCQQSYSAPFTFGPGTKVDIKR

SEQ ID NO: 994 - protein, 108 aa, Artificial Sequence
  NK77.35_CD70_DB02_H08_VL
DIQMTQSPSSLSASVGDRVTITCRASQEISNYLAWYQQKPGKAPKLLIYDASNLQTGVPSRFSGSGSGTDFTLTISSLQPEDFATYYCQQSYSTPFTFGPGTKVDIKR

SEQ ID NO: 995 - protein, 108 aa, Artificial Sequence
  NK77.36_CD70_DB03_A06_VL
DIQMTQSPSSLSASVGDRVTITCQASQDISDSLNWYQQKPGKAPKLLIYSASSLQSGVPSRFSGSGSGTDFTLTISSLQPEDFATYYCQQSFTTPYTFGQGTKVEIKR

SEQ ID NO: 996 - protein, 108 aa, Artificial Sequence
  NK77.37_CD70_DB03_A07_VL
DIQMTQSPSSLSASVGDRVTITCRASQSISSWLAWYQQKPGKAPKLLIYDASNLETGVPSRFSGSGSGTDFTLTISSLQPEDFATYYCQQNFSPPLTFGQGTRLEIKR

SEQ ID NO: 997 - protein, 108 aa, Artificial Sequence
  NK77.38_CD70_DB03_A08_VL
DIQMTQSPSSLSASVGDRVTITCRASQDIRHYLAWYQQKPGKAPKLLIYDASSLQSGVPSRFSGSGSGTDFTLTISSLQPEDFATYYCQQTYDAPITFGQGTRLEIKR

SEQ ID NO: 998 - protein, 107 aa, Artificial Sequence
  NK77.39_CD70_DB03_A09_VL
DIVMTQSPDSLAVSLGERATINCRASSSISNYLAWYQQKPGQPPKLLIYGASTRASGVPDRFSGSGSGTDFTLTISSLQAEDVAVYYCQQSYSTPLTFGQGTKVEIK

SEQ ID NO: 999 - protein, 108 aa, Artificial Sequence
  NK77.40_CD70_DB03_A11_VL
DIQMTQSPSSLSASVGDRVTITCRASQGITNFLAWYQQKPGKAPKLLIYDASNLETGVPSRFSGSGSGTDFTLTISSLQPEDFATYYCQQSYGAPLTFGQGTRLEIKR

SEQ ID NO: 1000 - protein, 108 aa, Artificial Sequence
  NK77.41_CD70_DB03_A12_VL
DIQMTQSPSSLSASVGDRVTITCQASQDISNYLNWYQQKPGKAPKLLIYSASTLQSGVPSRFSGSGSGTDFTLTISSLQPEDFATYYCQQSYSSPYRFGQGTKVEIKR

SEQ ID NO: 1001 - protein, 113 aa, Artificial Sequence
  NK77.42_CD70_DB03_B01_VL
DIVMTQSPLSLPVTPGEPASISCRSSQSLLHSNGYNYLDWYLQKPGQSPQLLIYAASSLQSGVPDRFSGSGSGTDFTLKISRVEAEDVGVYYCMQGAHWPPTFGQGTKLEIKR

SEQ ID NO: 1002 - protein, 108 aa, Artificial Sequence
  NK77.43_CD70_DB03_B04_VL
DIQMTQSPSSLSASVGDRVTITCRASQDIRDGLGWYQQKPGKAPKLLIYAASTLQSGVPSRFSGSGSGTDFTLTISSLQPEDFATYYCQQSYGTPPTFGQGTKVEIKR

SEQ ID NO: 1003 - protein, 107 aa, Artificial Sequence
  NK77.44_CD70_DB03_B06_VL
EIVMTQSPATLSVSPGERATLSCRASQSVSSYLAWYQQKPGQAPRLLIYGASTRATGIPARFSGSGSGTEFTLTISSLQSEDFAVYYCQQYDSSPTFGQGTKVEIKR

SEQ ID NO: 1004 - protein, 108 aa, Artificial Sequence
  NK77.45_CD70_DB03_B09_VL
DIQMTQSPSSLSASVGDRVTITCRASQSISSYLNWYQQKPGKAPKLLIYDASNLETGVPSRFSGSGSGTDFTLTISSLQPEDFATYYCQQSHSAPITFGQGTRLEIKR

SEQ ID NO: 1005 - protein, 108 aa, Artificial Sequence
  NK77.46_CD70_DB03_C05_VL
DIQMTQSPSSLSASVGDRVTITCRASQSISTNLAWYQQKPGKAPKLLIYDASYLEAGVPSRFSGSGSGTDFTLTISSLQPEDFATYYCQQSYSTPPTFGQGTKLEIKR

SEQ ID NO: 1006 - protein, 114 aa, Artificial Sequence
  NK77.47_CD70_DB03_D11_VL
DIVMTQSPDSLAVSLGERATINCKSSQSVLYSSNNKNYLAWYQQKPGQPPKLLIYWASTRDSGVPDRFSGSGSGTDFTLTISSLQAEDVAVYYCQQYYGFPPTFGQGTRLEIKR

SEQ ID NO: 1007 - protein, 108 aa, Artificial Sequence
  NK77.48_CD70_DB03_E01_VL
DIQMTQSPSSLSASVGDRVTITCQASHDISKFLNWYQQKPGKAPKLLIYDASNLQRGVPSRFSGSGSGTDFTLTISSLQPEDFATYYCQQTYSFPFTFGQGTKLEIKR

SEQ ID NO: 1008 - protein, 113 aa, Artificial Sequence
  NK77.49_CD70_DB03_E03_VL
DIVMTQSPLSLPVTPGEPASISCRSSQSLLHSNGYNYLDWYLQKPGQSPQLLIYDASSLQSGVPDRFSGSGSGTDFTLKISRVEAEDVGVYYCMQARQTPLTFGQGTRLEIKR

SEQ ID NO: 1009 - protein, 113 aa, Artificial Sequence
  NK77.50_CD70_DB03_E09_VL
DIVMTQSPLSLPVTPGEPASISCRSSQSLLHSNGYNYLDWYLQKPGQSPQLLIYAASNLQGGVPDRFSGSGSGTDFTLKISRVEAEDVGVYYCMQTLESPVTFGGGTKVEIKR

SEQ ID NO: 1010 - protein, 108 aa, Artificial Sequence
  NK77.51_CD70_DB03_F02_VL
DIQMTQSPSSLSASVGDRVTITCRASQGISNNLNWYQQKPGKAPKLLIYDASNLERGVPSRFSGSGSGTDFTLTISSLQPEDFATYYCQQSYDGPITFGQGTRLEIKR

SEQ ID NO: 1011 - protein, 108 aa, Artificial Sequence
  NK77.52_CD70_DB03_F05_VL
DIQMTQSPSSLSASVGDRVTITCRASQSISSWLAWYQQKPGKAPKLLIYAASSLQSGVPSRFSGSGSGTDFTLTISSLQPEDFATYYCLQDYSYPLTFGGGTKVEIKR

SEQ ID NO: 1012 - protein, 108 aa, Artificial Sequence
  NK77.53_CD70_DB03_F06_VL
DIQMTQSPSSLSASVGDRVTITCRASQSINRWLAWYQQKPGKAPKLLIYDASNLETGVPSRFSGSGSGTDFTLTISSLQPEDFATYYCQQSYITPLTFGGGTKVEIKR

SEQ ID NO: 1013 - protein, 108 aa, Artificial Sequence
  NK77.54_CD70_DB03_F09_VL
DIQMTQSPSSLSASVGDRVTITCQASQDISNYLNWYQQKPGKAPKLLIYDASSLESGVPSRFSGSGSGTDFTLTISSLQPEDFATYYCQQTNSFPITFGQGTRLEIKR

SEQ ID NO: 1014 - protein, 108 aa, Artificial Sequence
  NK77.55_CD70_DB03_F12_VL
DIQMTQSPSSLSASVGDRVTITCQASQDIRNFLNWYQQKPGKAPKLLIYAASTLQSGVPSRFSGSGSGTDFTLTISSLQPEDFATYYCQQSYSAPSTFGQGTKLEIKR

SEQ ID NO: 1015 - protein, 108 aa, Artificial Sequence
  NK77.56_CD70_DB03_G06_VL
DIQMTQSPSSLSASVGDRVTITCRASQSISNYLNWYQQKPGKAPKLLIYDASNLETGVPSRFSGSGSGTDFTLTISSLQPEDFATYYCQQSYSTPITFGQGTRLEIKR

SEQ ID NO: 1016 - protein, 108 aa, Artificial Sequence
  NK77.57_CD70_DB03_G11_VL
DIQMTQSPSSLSASVGDRVTITCRASETISGWLAWYQQKPGKAPKLLIYDASNLETGVPSRFSGSGSGTDFTLTISSLQPEDFATYYCQQSYSTPWTFGQGTKLEIKR

SEQ ID NO: 1017 - protein, 108 aa, Artificial Sequence
  NK77.58_CD70_DB03_H08_VL
DIQMTQSPSSLSASVGDRVTITCRASQGIGSWLAWYQQKPGKAPKLLIYAASTLQSGVPSRFSGSGSGTDFTLTISSLQPEDFATYYCQQSYSTPWTFGPGTKVDIKR

SEQ ID NO: 1018 - protein, 108 aa, Artificial Sequence
  NK77.59_CD70_DB03_H10_VL
DIQMTQSPSSLSASVGDRVTITCRASQSISSSLAWYQQKPGKAPKLLIYDASSLQSGVPSRFSGSGSGTDFTLTISSLQPEDFATYYCQQSYNTPPTFGGGTKLEIKR

SEQ ID NO: 1019 - protein, 108 aa, Artificial Sequence
  NK77.60_CD70_DB04_A05_VL
DIQMTQSPSSLSASVGDRVTITCRASQGIGGYLAWYQQKPGKAPKLLIYDASNLETGVPSRFSGSGSGTDFTLTISSLQPEDFATYYCQQSYDSPPTFGQGTRLEIKR

SEQ ID NO: 1020 - protein, 108 aa, Artificial Sequence
  NK77.61_CD70_DB04_A07_VL
DIQMTQSPSSLSASVGDRVTITCRASQSVSSYLNWYQQKPGKAPKLLIYDTSNLETGVPSRFSGSGSGTDFTLTISSLQPEDFATYYCQQAHSFPLTFGGGTKVEIKR

SEQ ID NO: 1021 - protein, 113 aa, Artificial Sequence
  NK77.62_CD70_DB04_A10_VL
DIVMTQSPLSLPVTPGEPASISCRSSQSLLHSNGYNYLDWYLQKPGQSPQLLIYLGSTRASGVPDRFSGSGSGTDFTLKISRVEAEDVGVYYCMQALDTPLTFGGGTKLEIKR

SEQ ID NO: 1022 - protein, 108 aa, Artificial Sequence
  NK77.63_CD70_DB04_A11_VL
DIQMTQSPSSLSASVGDRVTITCQASQDISNYLNWYQQKPGKAPKLLIYDTSNLQTGVPSRFSGSGSGTDFTLTISSLQPEDFATYYLSTDLQTTAHFGQGTKVEIKR

SEQ ID NO: 1023 - protein, 113 aa, Artificial Sequence
  NK77.64_CD70_DB04_B03_VL
DIVMTQSPLSLPVTPGEPASISCRSSQSLLHSNGYNYLDWYLQKPGQSPQLLIYDASSLQSGVPDRFSGSGSGTDFTLKISRVEAEDVGVYYCMQGTHWPPTFGQGTKVEIKR

SEQ ID NO: 1024 - protein, 108 aa, Artificial Sequence
  NK77.65_CD70_DB04_B05_VL
DIQMTQSPSSLSASVGDRVTITCRASQSVSRYLNWYQQKPGKAPKLLIYDASNLETGVPSRFSGSGSGTDFTLTISSLQPEDFATYYCQQADSFPVTFGQGTKLEIKR

SEQ ID NO: 1025 - protein, 108 aa, Artificial Sequence
  NK77.66_CD70_DB04_B07_VL
DIQMTQSPSSLSASVGDRVTITCRASQGISNNLNWYQQKPGKAPKLLIYHASNLETGVPSRFSGSGSGTDFTLTISSLQPEDFATYYCQQSYDGPMTFGQGTKLEIKR

SEQ ID NO: 1026 - protein, 113 aa, Artificial Sequence
  NK77.67_CD70_DB04_C01_VL
DIVMTQSPLSLPVTPGEPASISCRSSQSLLHSNGYNYLDWYLQKPGQSPQLLIYDASNLETGVPDRFSGSGSGTDFTLKISRVEAEDVGVYYCMQGTHWPPTFGQGTKVEIKR

SEQ ID NO: 1027 - protein, 108 aa, Artificial Sequence
  NK77.68_CD70_DB04_C04_VL
DIQMTQSPSSLSASVGDRVTITCQASQDISNYLNWYQQKPGKAPKLLIYDASNLETGVPSRFSGSGSGTDFTLTISSLQPEDFATYYCQQSYDGPITFGQGTRLEIKR

SEQ ID NO: 1028 - protein, 108 aa, Artificial Sequence
  NK77.69_CD70_DB04_C06_VL
DIQMTQSPSSLSASVGDRVTITCRASQSISSYLNWYQQKPGKAPKLLIYDASNLETGVPSRFSGSGSGTDFTLTISSLQPEDFATYYCQQSYNTPPTFGGGTKVEIKR

SEQ ID NO: 1029 - protein, 108 aa, Artificial Sequence
  NK77.70_CD70_DB04_C07_VL
DIQMTQSPSSLSASVGDRVTITCQASQDISNYLNWYQQKPGKAPKLLIYGASSLQSGVPSRFSGSGSGTDFTLTISSLQPEDFATYYCLQDAATPITFGQGTRLEIKR

SEQ ID NO: 1030 - protein, 108 aa, Artificial Sequence
  NK77.71_CD70_DB04_D02_VL
DIQMTQSPSSLSASVGDRVTITCRASQSIGNWLAWYQQKPGKAPKLLIYDASDLETGVPSRFSGSGSGTDFTLTISSLQPEDFATYYCQQSYTTPWTFGQGTKVEIKR

SEQ ID NO: 1031 - protein, 113 aa, Artificial Sequence
  NK77.72_CD70_DB04_D05_VL
DIVMTQSPLSLPVTPGEPASISCRSSQSLLHSNGYNYLDWYLQKPGQSPQLLIYEVSNRASGVPDRFSGSGSGTDFTLKISRVEAEDVGVYYCMKGLQTPLTFGPGTKVDIKR

SEQ ID NO: 1032 - protein, 108 aa, Artificial Sequence
  NK77.73_CD70_DB04_D07_VL
DIQMTQSPSSLSASVGDRVTITCRASQGISNYLAWYQQKPGKAPKLLIYAASSLQSGVPSRFSGSGSGTDFTLTISSLQPEDFATYYCQQSHSTPLTFGQGTKVEIKR

SEQ ID NO: 1033 - protein, 108 aa, Artificial Sequence
  NK77.74_CD70_DB04_D08_VL
DIQMTQSPSSLSASVGDRVTITCRASQGISNNLNWYQQKPGKAPKLLIYDASNLETGVPSRFSGSGSGTDFTLTISSLQPEDFATYYCQQSYSTPYTFGQGTKVEIKR

SEQ ID NO: 1034 - protein, 108 aa, Artificial Sequence
  NK77.75_CD70_DB04_D10_VL
DIQMTQSPSSLSASVGDRVTITCRASQDIGNDLGWYQQKPGKAPKLLIYAASSLQSGVPSRFSGSGSGTDFTLTISSLQPEDFATYYCLQDYDYPLTFGQGTKVEIKR

SEQ ID NO: 1035 - protein, 107 aa, Artificial Sequence
  NK77.85_CD70_DB03_B02_VL
DIQMTQSPSSLSASVGDRVTITCRASQSISSYLNWYQQKPGKAPKLLIYDASNLETGVPSRFSGSGSGTDFTLTISSLQPEDFATYYCQQSYNTPYSFGQGTKVEIK

SEQ ID NO: 1036 - protein, 108 aa, Artificial Sequence
  NK77.86_CD70_DB04_A06_VL
DIQMTQSPSSLSASVGDRVTITCRTSQSISSYLNWYQQKPGKAPKLLIYDASNLETGVPSRFSGSGSGTDFTLTISSLQPEDFATYYCLQDYSYPLTFGQGTKVEIKR

SEQ ID NO: 1037 - protein, 108 aa, Artificial Sequence
  NK77.87_CD70_DB04_A09_VL
DIQMTQSPSSLSASVGDRVTITCQASQDISNYLNWYQQKPGKAPKLLIYDASSLQSGVPSRFSGSGSGTDFTLTISSLQPEDFATYYCQQSYSTPPAFGQGTKVEIKR

SEQ ID NO: 1038 - DNA, 354 bp, Artificial Sequence
  NK77.1_CD70_DB01_C03_VH_DNA
caggtgcagctggtgcagtctggggctgaggtgaagaagcctggggcctcagtgaaggtctcctgcaaggcttctggatacaccttcaccggccattatttgcactgggtgcgacaggcccctggacaagggcttgagtggatgggatggatcaaccctaacagtggtggcacaaactatgcacagaagtttcagggcagggtcaccatgaccagggacacgtccactagcacagtgtacatggagctgagcagcctgagatctgaggacacggccgtgtattactgtgttagaggaagcggttggtatgacctggactactggggccaagggaccctggtcaccgtctcctca

SEQ ID NO: 1039 - DNA, 357 bp, Artificial Sequence
  NK77.2_CD70_DB01_D02_VH_DNA
caggtgcagctggtgcagtctggggctgaggtgaagaagcctggggcctcagtgaaggtttcctgcaaggcatctggatacaccttcaccaactactatatgcactgggtgcgacaggcccctggacaagggcttgagtggatgggaataatcaaccctagtggtgggagcacaagctacgcacagaagttccagggcagagtcaccatgaccagggacacgtccacgagcacagtctacatggagctgagcagcctgagatctgaggacacggccgtgtattactgtgctagagaactaggagtcgccgggtacttcgatctctggggccgtggcaccctggtcactgtctcctca

SEQ ID NO: 1040 - DNA, 369 bp, Artificial Sequence
  NK77.3_CD70_DB01_E06_VH_DNA
caggtgcagctggtgcagtctggggctgaggtgaagaagcctggggcctcagtgaaggtttcctgcaaggcatctggatacaccttcaccggttactatatccactgggtgcgacaggcccctggacaagggcttgagtggatgggaataatcaaccctagtggtggaagcacaagctacgcacagaagttccagggcagagtcaccatgaccagggacacgtccacgagcacagtctacatggagctgagcagcctgagatctgaggacacggccgtgtattactgtgctagagacctgtcagggatcgacggatatattggtttctttgactactggggccaagggaccctggtcaccgtctcctca

SEQ ID NO: 1041 - DNA, 357 bp, Artificial Sequence
  NK77.4_CD70_DB01_G04_VH_DNA
caggtgcagctggtgcagtctggggctgaggtgaagaagcctggggcctcagtgaaggtttcctgcaaggcatctggaggaaccttcagaagccatgtcatatcctgggtgcgacaggcccctggacaagggcttgagtggatgggaataatcgatcctagtggtggcagcacaagctacgcacagaggttccagggcagagtcaccatgaccagggacacgtccacgagcacagtctacatggagctgagcagcctgagatctgaggacacggccgtgtattactgtgctaaagattacactgggctgcttggaatggatgtctggggccaagggacaaccgtcaccgtctcttca

SEQ ID NO: 1042 - DNA, 357 bp, Artificial Sequence
  NK77.5_CD70_DB01_G05_VH_DNA
caggtgcagctggtgcagtctggggctgaggtgaagaagcctggggcctcagtgaaggtctcctgcaaggcttctggatacaccttcatcgactattatatccattgggtgcgacaggcccctggacaagggcttgagtggatgggatggatgaaccccaacagtggtaacacaggctatgcacagaagttccagggcagagtcaccatgaccagggacacctccacaagcacagtctacatggagctgagcagcctgagatctgaggacacggccgtgtattactgtgcgagaggcctttccggctacgacttggacgactactggggccaagggaccctggtcaccgtctcctca

SEQ ID NO: 1043 - DNA, 354 bp, Artificial Sequence
  NK77.6_CD70_DB01_G07_VH_DNA
caggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggatggatcaacccgaacagtggtggcacaaaatacgcacataagttccagggcagagtcaccatgaccagggacacgtccacgagcacagtctacatggagctgagcagcctgagatctgaggacacggccgtgtattactgtgctagaggactgtcaggttacgattttgactactggggccaagggaccacagtcaccgtctcctca

SEQ ID NO: 1044 - DNA, 357 bp, Artificial Sequence
  NK77.7_CD70_DB01_G11_VH_DNA
caggtgcagctggtgcagtctggggctgaggtgaagaagcctggggcctcagtgaaggtttcctgcaaggcatctggatacaccttcaccggctactatatgcactgggtgcgacaggcccctggacaagggcttgagtggatgggatggatgaaccctaatagtggtaacacaggctacgcacagaagttccagggcagagtcaccatgaccagggacacgtccacgagcacagtctacatggagctgagcagcctgagatctgaggacacggccgtgtattactgtgctagagggaccgacgtgtatggagactttgactactggggccaagggaccctggtcaccgtctcctca

SEQ ID NO: 1045 - DNA, 378 bp, Artificial Sequence
  NK77.9_CD70_DB02_A03_VH_DNA
caggtgcagctggtgcagtctggggctgaggtgaagaagcctgggtcctcggtgaaggtctcctgcaaggcttctggatacaccttcacagagaacgaaatgcattgggtgcgacaggcccctggacaagggcttgagtggatgggaggcatcatccctatctttggtacagcaaactacgcacagaagttccagggcagagtcacgattaccgcggacgaatccacgagcacagcctacatggagctgagcagcctgagatctgaggacacggccgtgtattactgtgcgagagagggaggaaccgccatggccaccggttattactactatgggatggacgtgtggggccaagggaccaccgtcaccgtctcctca

SEQ ID NO: 1046 - DNA, 357 bp, Artificial Sequence
  NK77.10_CD70_DB02_A04_VH_DNA
caggtgcagctggtgcagtctggggctgaggtgaagaagcctggggcctcagtgaaggtttcctgcaaggcatctggatacaccttcaccgagaatgaaatgcactgggtgcgacaggcccctggacaagggcttgagtggatgggatggatcaactctaatggtggctacacagggtacgcactgaagttccagggcagagtcaccatgaccagggacacgtccacgagcacagtctacatggagctgagcagcctgagatctgaggacacggccgtgtattactgtgctagagccagtaattacggaggacactttgactactggggccaagggaccctggtcaccgtctcctca

SEQ ID NO: 1047 - DNA, 360 bp, Artificial Sequence
  NK77.11_CD70_DB02_A05_VH_DNA
caggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggcagcacaatatacgcacagaagttccagggcagagtcaccatgaccagggacacgtccacgagcacagtctacatggagctgagcagcctgagatctgaggacacggccgtgtattactgtgctaaagacatgggagcgtgggcagctggttttgactactggggccaagggaccctggtcaccgtctcctca

SEQ ID NO: 1048 - DNA, 360 bp, Artificial Sequence
  NK77.12_CD70_DB02_A06_VH_DNA
caggtgcagctggtgcagtctggggctgaggtgaagaagcctggggcctcagtgaaggtttcctgcaaggcatctggatacaccttcaccgggtactatatgcactgggtgcgacaggcccctggacaagggcttgagtggatgggatggatcaacccaaatagtggtgatacagggtacgcacagaagttccagggcagagtcaccatgaccagggacacgtccacgagcacagtctacatggagctgagcagcctgagatctgaggacacggccgtgtattactgtgctagatccgtcaacgactacggtgattacgacggttactggggccaagggaccctggtcaccgtctcctca

SEQ ID NO: 1049 - DNA, 360 bp, Artificial Sequence
  NK77.13_CD70_DB02_A07_VH_DNA
caggtgcagctggtgcagtctggggctgaggtgaagaagcctggggcctcagtgaaggtttcctgcaaggcatctggatacaccttcaccggatactatatgcactgggtgcgacaggcccctggacaagggcttgagtggatgggaataatcaaccctagtggtgggagcacaagctacgcacagaagttccagggcagagtcaccatgaccagggacacgtccacgagcacagtctacatggagctgagcagcctgagatctgaggacacggccgtgtattactgtgctagagattacggtgattatgacgcctcgtttgactactggggccaagggaccctggtcaccgtctcctca

SEQ ID NO: 1050 - DNA, 351 bp, Artificial Sequence
  NK77.14_CD70_DB02_A08_VH_DNA
caggtgcagctggtgcagtctggggctgaggtgaagaagcctggggcctcagtgaaggtttcctgcaaggcatctggatacaccttcaccagctacgatatcaattgggtgcgacaggcccctggacaagggcttgagtggatgggaataatcaacccctccgatggtagcacaatctacgcacagaacttccagggcagagtcaccatgaccagggacacgtccacgagcacagtctacatggagctgagcagcctgagatctgaggacacggccgtgtattactgtgtgaaggaagaggcctggtacttcgatctctggggccgtggcaccctggtcactgtctcctca

SEQ ID NO: 1051 - DNA, 351 bp, Artificial Sequence
  NK77.15_CD70_DB02_A09_VH_DNA
caggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggatggatgaaccctgataacggtgatacagggtacgcacagatgttccagggcagagtcaccatgaccagggacacgtccacgagcacagtctacatggagctgagcagcctgagatctgaggacacggccgtgtattactgtgcttcaggggattactatgacatcttgtactggggccaagggaccctggtcaccgtctcctca

SEQ ID NO: 1052 - DNA, 354 bp, Artificial Sequence
  NK77.16_CD70_DB02_A11_VH_DNA
caggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggatggatgaaccccaacagtggtgatacaggatacgcacagaagttccagggcagagtcaccatgaccagggacacgtccacgagcacagtctacatggagctgagcagcctgagatctgaggacacggccgtgtattactgtgctagagggcccagcgggtacgaatttgactactggggccaagggaccctggtcaccgtctcctca

SEQ ID NO: 1053 - DNA, 366 bp, Artificial Sequence
  NK77.17_CD70_DB02_B06_VH_DNA
caggtgcagctggtgcagtctggggctgaggtgaagaagcctggggcctcagtgaaggtttcctgcaaggcatctggatacaccttcaccgattactatatgcactgggtgcgacaggcccctggacaagggcttgagtggatgggaataatcaaccctaatagtggtggaacaaattacgcacagaagttccagggcagagtcaccatgaccagggacacgtccacgagcacagtctacatggagctgagcagcctgagatctgaggacacggccgtgtattactgtgctagagattttagtgtgtatgctgctgcagatggcatggatgtctggggccaagggacattggtcaccgtctcttca

SEQ ID NO: 1054 - DNA, 363 bp, Artificial Sequence
  NK77.18_CD70_DB02_B09_VH_DNA
caggtgcagctggtgcagtctggggctgaggtgaagaagcctggggcctcagtgaaggtttcctgcaaggcatctggatacaccttcaccgggtactatatgcactgggtgcgacaggcccctggacaagggcttgagtggatgggaataatcaaccctggggatggcggtacaatctacgcacagaatttccagggcagagtcaccatgaccagggacacgtccacgagcacagtctacatggagctgagcagcctgagatctgaggacacggccgtgtattactgtgctagaggattcggcgagtcagcccccgatgcttttgatatctggggccaagggacaatggtcaccgtctcttca

SEQ ID NO: 1055 - DNA, 354 bp, Artificial Sequence
  NK77.19_CD70_DB02_C03_VH_DNA
caggtgcagctggtgcagtctggggctgaggtgaagaagcctggggcctcagtgaaggtttcctgcaaggcatctggatacaccttcaccggttactatatgcactgggtgcgacaggcccctggacaagggcttgagtggatgggaataatcaaccctagtggtgggagcacaagctacgcacagaagttccagggcagagtcaccatgaccagggacacgtccacgagcacagtctacatggagctgagcagcctgagatctgaggacacggccgtgtattactgtgctgccgggacagagatctactacatggacgtctggggcaaagggaccacggtcaccgtctcctca

SEQ ID NO: 1056 - DNA, 381 bp, Artificial Sequence
  NK77.20_CD70_DB02_C04_VH_DNA
caagtgcagttagttcagtcaggcgccgaagttaaaaaacccggagcgagcgtaaaagtgtcttgtaaagccagtggcggcacatttagctcttatgcgatatcatgggttcgccaagcaccaggccagggcctggaatggatggggatgataaatccaagtgatggcgccactacttacgcacagaagttccagggcagagtcaccatgaccagggacacgtccacgagcacagtctacatggagctgagcagcctgagatctgaggacacggccgtgtattactgtgctagagagagggagctactacatttcgccacaaattattactactatggtatggacgtgtggggccaagggaccaccgtcaccgtctcctca

SEQ ID NO: 1057 - DNA, 369 bp, Artificial Sequence
  NK77.22_CD70_DB02_C07_VH_DNA
caggtgcagctggtgcagtctggggctgaggtgaagaagcctggggcctcagtgaaggtttcctgcaaggcatctggatacaccttcacccggaactatatgcactgggtgcgacaggcccctggacaagggcttgagtggatgggatggatctctcctgacaatggtgttacaaattacgcacagaatttccagggcagagtcaccatgaccagggacacgtccacgagcacagtctacatggagctgagcagcctgagatctgaggacacggccgtgtattactgtgctaagacacaaggctcatccagctggtatcagtggtacttcgatctctggggccgtggcaccctggtcactgtctcctca

SEQ ID NO: 1058 - DNA, 357 bp, Artificial Sequence
  NK77.24_CD70_DB02_D02_VH_DNA
caggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcgatccagggagtggtgacacaagctacgcacagaagttccagggcagagtcaccatgaccagggacacgtccacgagcacagtctacatggagctgagcagcctgagatctgaggacacggccgtgtattactgtgctagagggtccaactggtacgactactttgactactggggccaagggaccctggtcaccgtctcctca

SEQ ID NO: 1059 - DNA, 357 bp, Artificial Sequence
  NK77.25_CD70_DB02_D04_VH_DNA
caggtgcagctggtgcagtctggggctgaggtgaagaagcctggggcctcagtgaaggtttcctgcaaggcatctggataccgcctgagcgaccattatatgcactgggtgcgacaggcccctggacaagggcttgagtggatgggaataatcaaccctagtggtgggagcacaacatacgcacagaacttccagggcagagtcaccatgaccagggacacgtccacgagcacagtctacatggagctgagcagcctgagatctgaggacacggccgtgtattactgtgcttccagttactatggtgactacgtcttggtgaattggggccaagggaccctggtcaccgtctcctca

SEQ ID NO: 1060 - DNA, 360 bp, Artificial Sequence
  NK77.26_CD70_DB02_D10_VH_DNA
caggtgcagctggtgcagtctggggctgaggtgaagaagcctggggcctcagtgaaggtttcctgcaaggcatctggatacaccttcaccgattactatgtccactgggtgcgacaggcccctggacaagggcttgagtggatgggatggatcaacccgaatactggtgggacaagcttcgcacagaatttccagggcagagtcaccatgaccagggacacgtccacgagcacagtctacatggagctgagcagcctgagatctgaggacacggccgtgtattactgtgctagagatctgggtcaatggttgggagagattgactactggggccaagggaccctggtcaccgtctcctca

SEQ ID NO: 1061 - DNA, 372 bp, Artificial Sequence
  NK77.27_CD70_DB02_D11_VH_DNA
caggtgcagctggtgcagtctggggctgaggtgaagaagcctggggcctcagtgaaggtttcctgcaaggcatctggatacaccttcaccgactacaccgattactttgtgcactgggtgcgacaggcccctggacaagggcttgagtggatgggaatattcaaccctagtgatggtagcacaagctacgcacaggaattccagggcagagtcaccatgaccagggacacgtccacgagcacagtctacatggagctgagcagcctgagatctgaggacacggccgtgtattactgtgctagaggaccttacagtagtagctggtattactttgactactggggccaagggaccctggtcaccgtctcctca

SEQ ID NO: 1062 - DNA, 360 bp, Artificial Sequence
  NK77.28_CD70_DB02_E04_VH_DNA
caggtgcagctggtgcagtctggggctgaggtgaagaagcctggggcctcagtgaaggtttcctgcaaggcatctggatacatcttcaccgattactatatgcactgggtgcgacaggcccctggacaagggcttgagtggatgggaataatcaaccctagtggtggagatacactttacgcacagaagttccagggcagagtcaccatgaccagggacacgtccacgagcacagtctacatggagctgagcagcctgagatctgaggacacggccgtgtattactgtgctagagaaggcgtaggagctatgggcgtgtttgactactggggccaagggaccctggtcaccgtctcctca

SEQ ID NO: 1063 - DNA, 366 bp, Artificial Sequence
  NK77.29_CD70_DB02_F06_VH_DNA
caggtgcagctggtgcagtctggggctgaggtgaagaagcctggggcctcagtgaaggtttcctgcaaggcatctggatacaccttcaccgatcactatatccactgggtgcgacaggcccctggacaagggcttgagtggatgggatggatcagtgcgtacaatggtaaaacaaattacgcacagaagttccagggcagagtcaccatgaccagggacacgtccacgagcacagtctacatggagctgagcagcctgagatctgaggacacggccgtgtattactgtgctagagacacaatctactatgacttttggagtgggtacgactactggggccaagggaccctggtcaccgtctcctca

SEQ ID NO: 1064 - DNA, 366 bp, Artificial Sequence
  NK77.31_CD70_DB02_F08_VH_DNA
caggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggcgcgacaatctacgcacagaagttccagggcagagtcaccatgaccagggacacgtccacgagcacagtctacatggagctgagcagcctgagatctgaggacacggccgtgtattactgtgctagatctcgcggtgactactatggaagcggggattttgactactggggccaagggaccctggtcaccgtctcctca

SEQ ID NO: 1065 - DNA, 354 bp, Artificial Sequence
  NK77.32_CD70_DB02_G07_VH_DNA
caggtgcagctggtgcagtctggggctgaggtgaagaagcctggggcctcagtgaaggtttcctgcaaggcatctggatacaccttcaccgattactatatgcactgggtgcgacaggcccctggacaagggcttgagtggatgggaataatcaaccctagtggtggaagcacaagctacgcacagaagttccagggcagagtcaccatgaccagggacacgtccacgagcacagtctacatggagctgagcagcctgagatctgaggacacggccgtgtattactgtgctagaggatattttgatcacgcattcgatatctggggccaagggacaatggtcaccgtctcttca

SEQ ID NO: 1066 - DNA, 372 bp, Artificial Sequence
  NK77.33_CD70_DB02_H04_VH_DNA
caggtgcagctggtgcagtctggggctgaggtgaagaagcctggggcctcagtgaaggtttcctgcaaggcatctggatacaccttcaccggttactatatgcactgggtgcgacaggcccctggacaagggcttgagtggatgggaataatcaaccctagtggtggggatacaatatacgcacagaagttccagggcagagtcaccatgaccagggacacgtccacgagcacagtctacatggagctgagcagcctgagatctgaggacacggccgtgtattactgtgctagaggtgactcgtcttcatggtacgactattactactacatggacgtctggggcaaagggaccacggtcaccgtctcctca

SEQ ID NO: 1067 - DNA, 357 bp, Artificial Sequence
  NK77.34_CD70_DB02_H05_VH_DNA
caggtgcagctggtgcagtctggggctgaggtgaagaagcctggggcctcagtgaaggtttcctgcaaggcatctggatacaccttcaccgactactttacccactgggtgcgacaggcccctggacaagggcttgagtggatgggatggatcaacacatatgacggtaatacaaattacgcacagaagttccagggcagagtcaccatgaccagggacacgtccacgagcacagtctacatggagctgagcagcctgagatctgaggacacggccgtgtattactgtgctagagaaatggagtggctcggccaggtggactactggggccaagggaccctggtcaccgtctcctca

SEQ ID NO: 1068 - DNA, 357 bp, Artificial Sequence
  NK77.35_CD70_DB02_H08_VH_DNA
caggtgcagctggtgcagtctggggctgaggtgaagaagcctggggcctcagtgaaggtttcctgcaaggcatctggatacaccttcaccagctactatatacactgggtgcgacaggcccctggacaagggcttgagtggatgggacgaatcaaccctaatggtggagggacaaactacgcacagaagttccagggcagagtcaccatgaccagggacacgtccacgagcacagtctacatggagctgagcagcctgagatctgaggacacggccgtgtattactgtgctagaggccacagagggggtggcgggattgactactggggccaagggaccctggtcaccgtctcctca

SEQ ID NO: 1069 - DNA, 357 bp, Artificial Sequence
  NK77.36_CD70_DB03_A06_VH_DNA
caggtgcagctggtgcagtctggggctgaggtgaagaagcctggggcctcagtgaaggtttcctgcaaggcatctggaggtaccttcagtagctacgcaatttcatgggtgcgacaggcccctggacaagggcttgagtggatgggatggatctctcccaacagtggtgacacacactacgcacagaagttccagggcagagtcaccatgaccagggacacgtccacgagcacagtctacatggagctgagcagcctgagatctgaggacacggccgtgtattactgtgctagagactgggggtcaggctggtacgtggactactggggccaagggaccctggtcaccgtctcctca

SEQ ID NO: 1070 - DNA, 357 bp, Artificial Sequence
  NK77.37_CD70_DB03_A07_VH_DNA
caggtgcagctggtgcagtctggggctgaggtgaagaagcctgggtcctcggtgaaggtctcctgcaaggcttctggaggcaccttcaatagctatggaatcagctgggtgcgacaggcccctggacaagggcttgagtggatgggaggtatcatccctatctttggtacagcaaactacgcacagaagttccagggcagagtcacgattaccgcggacgaatccacgagcacagcctacatggagctgagcagcctgagatctgaggacacggccgtgtattactgtgcgagagatacctacggggatgacgcttttgatatctggggccaagggacaatggtcaccgtctcttca

SEQ ID NO: 1071 - DNA, 372 bp, Artificial Sequence
  NK77.38_CD70_DB03_A08_VH_DNA
caggtgcagctggtgcagtctggggctgaggtgaagaagcctggggcctcagtgaaggtttcctgcaaggcatctggatacagtttcaccagctactatatgcactgggtgcgacaggcccctggacaagggcttgagtggatgggaataatcaaccctagtggtgggactacaagctacgcacagaagttccagggcagagtcaccatgaccagggacacgtccacgagcacagtctacatggagctgagcagcctgagatctgaggacacggccgtgtattactgtgctagagacaattccccgtatagctcaagctggtgggactactttgactactggggccaagggaccctggtcaccgtctcctca

SEQ ID NO: 1072 - DNA, 366 bp, Artificial Sequence
  NK77.39_CD70_DB03_A09_VH_DNA
caggtgcagctggtgcagtctggggctgaggtgaagaagcctggggcctcagtgaaggtttcctgcaaggcatctggatacaccttcaccgattactatattcactgggtgcgacaggcccctggacaagggcttgagtggatgggatggatcaccccgaacagtggttatacatattacgcacagaatttccagggcagagtcaccatgaccagggacacgtccacgagcacagtctacatggagctgagcagcctgagatctgaggacacggccgtgtattactgtgctagaaacacagactgttatggggacttcctggggctggatgtctggggccaagggacaacggtcaccgtctcttca

SEQ ID NO: 1073 - DNA, 366 bp, Artificial Sequence
  NK77.40_CD70_DB03_A11_VH_DNA
caggtgcagctggtgcagtctggggctgaggtgaagaagcctggggcctcagtgaaggtttcctgcaaggcatctggatacaccttcaacggctaccttatgcactgggtgcgacaggcccctggacaagggcttgagtggatgggaatagttaacccttccgatggtagcacaggctacgcacagaagttccagggcagagtcaccatgaccagggacacgtccacgagcacagtctacatggagctgagcagcctgagatctgaggacacggccgtgtattactgtgcgaaggacacaggactccgctactttgactggctacttgactactggggccaagggaccctggtcaccgtctcctca

SEQ ID NO: 1074 - DNA, 354 bp, Artificial Sequence
  NK77.41_CD70_DB03_A12_VH_DNA
caggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcgatcctagtggtggccgaacaatttacgcacagcgcttccagggcagagtcaccatgaccagggacacgtccacgagcacagtctacatggagctgagcagcctgagatctgaggacacggccgtgtattactgtgctagacacgaagcaggcggaatctttgactactggggccaagggaccctggtcaccgtctcctca

SEQ ID NO: 1075 - DNA, 363 bp, Artificial Sequence
  NK77.42_CD70_DB03_B01_VH_DNA
caggtccagctggtgcagtctggggctgaggtgaagaagcctgggtcctcagtgaaggtctcctgcaaggcttctggatataccttcagcgactcctacatgcattgggtgcgacaggcccctggacaagggcttgagtgggtcggagggatcatccctatggcaggtatacccgcctacgcagaggaattccagggcagagtcacgattaccgcggacgagtccacgagcacagcctacatggagctgagcagcctgagatctgaggacacggccgtgtattactgtgcgagagccgacgattatgggggaaattggtacttcgatctctggggccgtggcaccctggtcactgtctcctca

SEQ ID NO: 1076 - DNA, 360 bp, Artificial Sequence
  NK77.43_CD70_DB03_B04_VH_DNA
caggtgcagctggtgcagtctggggctgaggtgaagaagcctggggcctcagtgaaggtttcctgcaaggcatctggatacatcttcaccgactactatatgcactgggtgcgacaggcccctggacaagggcttgagtggatgggaataatcaaccctagtggtggcagcacaagctacgcacagaagttccagggcagagtcaccatgaccagggacacgtccacgagcacagtctacatggagctgagcagcctgagatctgaggacacggccgtgtattactgtgctagagactcaggatggtatgagtcctggttcgacccctggggccagggaaccctggtcaccgtctcctca

SEQ ID NO: 1077 - DNA, 366 bp, Artificial Sequence
  NK77.44_CD70_DB03_B06_VH_DNA
caggtgcagctggtgcagtctggggctgaggtgaagaagcctggggcctcagtgaaggtttcctgcaaggcatctggatacaccttcaccgactactatcttcactgggtgcgacaggcccctggacaagggcttgagtggatgggatggatcagcgcctacaatggtaacacaaattacgcacagaagttccagggcagagtcaccatgaccagggacacgtccacgagcacagtctacatggagctgagcagcctgagatctgaggacacggccgtgtattactgtgctagagagattgtgggtgctacagaagattggtacttcgatctctggggccgtggcaccctggtcactgtctcctca

SEQ ID NO: 1078 - DNA, 357 bp, Artificial Sequence
  NK77.45_CD70_DB03_B09_VH_DNA
caggtgcagctggtgcagtctggggctgaggtgaagaagcctggggcctcagtgaaggtttcctgcaaggcatctggatacaccttcaccgcctactatctgcactgggtgcgacaggcccctggacaagggcttgagtggatgggaatgatcaaccccaacaatggtggcacaatttacgcacagacattccagggcagagtcaccatgaccagggacacgtccacgagcacagtctacatggagctgagcagcctgagatctgaggacacggccgtgtattactgtgctagagacctgggcggctacgtcctgtttgactactggggccaagggaccctggtcaccgtctcctca

SEQ ID NO: 1079 - DNA, 357 bp, Artificial Sequence
  NK77.46_CD70_DB03_C05_VH_DNA
caggtgcagctggtgcagtctggggctgaggtgaagaagcctggggcctcagtgaaggtttcctgcaaggcatctggatacaccttcaccgactactatattcactgggtgcgacaggcccctggacaagggcttgagtggatgggaatgatcaaccctagaggaggtagcacaacttacgcacagtcattccagggcagagtcaccatgaccagggacacgtccacgagcacagtctacatggagctgagcagcctgagatctgaggacacggccgtgtattactgtgctagagatttaggtgactatggggactacgactactggggccaagggaccctggtcaccgtctcctca

SEQ ID NO: 1080 - DNA, 372 bp, Artificial Sequence
  NK77.47_CD70_DB03_D11_VH_DNA
gaggtgcagctgttggagtctgggggaggcttggtacagcctggggggtccctgagactctcctgtgcagcctctggattcacctttagcaattcagatatgaattgggtccgccaggctccagggaaggggctggagtgggtctcagctattagtggtggaggtgacacactctactacgcagactccgtgaagggccggttcaccatctccagagacaattccaagaacacgctgtatctgcaaatgaacagcctgagagccgaggacacggccgtatattactgtgcgatggccagcgctttggacagtagcggtgacaatgaggcttttgatatctggggccaagggacaacagtcaccgtctcttca

SEQ ID NO: 1081 - DNA, 366 bp, Artificial Sequence
  NK77.48_CD70_DB03_E01_VH_DNA
caggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggatggatcaacccaaataacggtggtacaagctacgcacagaagttccagggcagagtcaccatgaccagggacacgtccacgagcacagtctacatggagctgagcagcctgagatctgaggacacggccgtgtattactgtgctagagtggaggacgatttctggagcggccctagctttgactactggggccaagggaccctggtcaccgtctcctca

SEQ ID NO: 1082 - DNA, 357 bp, Artificial Sequence
  NK77.49_CD70_DB03_E03_VH_DNA
caggtgcagctggtgcagtctggggctgaggtgaagaagcctgggtcctcggtgaaggtctcctgcaaggcttctggaggcaccttcaccaattatgctttcagctgggtgcgacaggcccctggacaagggcttgagtggatgggaggtatcatccctatcagcggtgccgcaaactacgcacagaagttccagggcagagtcacgattaccgcggacgaatccacgagcacagcctacatggagctgagcagcctgagatctgaggacacggccgtgtattactgtgcgagagggtccggactggacgatgcttttgatatctggggccaagggacaatggtcaccgtctcttca

SEQ ID NO: 1083 - DNA, 387 bp, Artificial Sequence
  NK77.50_CD70_DB03_E09_VH_DNA
caggtgcagctggtgcagtctggggctgaggtgaagaagcctggggcctcagtgaaggtttcctgcaaggcatctggatacaccttcaccgcgtactatatgcactgggtgcgacaggcccctggacaagggcttgagtggatgggatggatgaaccccaatagtggtaacacaggatacgcacagaagttccagggcagagtcaccatgaccagggacacgtccacgagcacagtctacatggagctgagcagcctgagatctgaggacacggccgtgtattactgtgctagagagggcagaatcgattacggggactacgacgactactactattactacggtatggacgtgtggggccaagggaccactgtcaccgtctcctca

SEQ ID NO: 1084 - DNA, 360 bp, Artificial Sequence
  NK77.51_CD70_DB03_F02_VH_DNA
caggtgcagctggtgcagtctggggctgaggtgaagaagcctggggcctcagtgaaggtttcctgcaaggcatctggatacaccttcaccgattactatgtgcactgggtgcgacaggcccctggacaagggcttgagtggatgggaacgatcaaccctagtggtgggagcacaagctacgcacagaagttccagggcagagtcaccatgaccagggacacgtccacgagcacagtctacatggagctgagcagcctgagatctgaggacacggccgtgtattactgtgctagagaccagggactctggttcaccggttttgactactggggccaagggaccctggtcaccgtctcctca

SEQ ID NO: 1085 - DNA, 360 bp, Artificial Sequence
  NK77.52_CD70_DB03_F05_VH_DNA
caggtgcagctggtgcagtctggggctgaggtgaagaagcctggggcctcagtgaaggtttcctgcaaggcatctggatacaccttcaccgcctaccacatgcactgggtgcgacaggcccctggacaagggcttgagtggatgggaataatcaaccctggagacggtgccacagggtacgcacagaatctccagggcagagtcaccatgaccagggacacgtccacgagcacagtctacatggagctgagcagcctgagatctgaggacacggccgtgtattactgtgctggtgagggcatttccggatcagatgcttttgatatctggggccaagggacattagtcaccgtctcttca

SEQ ID NO: 1086 - DNA, 354 bp, Artificial Sequence
  NK77.53_CD70_DB03_F06_VH_DNA
caggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggatggatgaatcctaactctggtaacacaggttacgcacagaagttccagggcagagtcacgattaccgcggacgaatccacgagcacagcctacatggagctgagcagcctgagatctgaggacacggccgtgtattactgtgcgtggggagtcgatccgtactactttgactactggggccaagggaccctggtcaccgtctcctca

SEQ ID NO: 1087 - DNA, 354 bp, Artificial Sequence
  NK77.54_CD70_DB03_F09_VH_DNA
caggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaatattcaacccctccgatggtagcacaagctacgcacagaagttccagggcagagtcaccatgaccagggacacgtccacgagcacagtctacatggagctgagcagcctgagatctgaggacacggccgtgtattactgtgctagagatgttggtgagaccacgttcgacccctggggccagggaaccctggtcaccgtctcctca

SEQ ID NO: 1088 - DNA, 369 bp, Artificial Sequence
  NK77.55_CD70_DB03_F12_VH_DNA
caggtgcagctcgttcaaagcggcgccgaggtcaagaaaccaggcgctagcgttaaagttagttgtaaagcctccggctatactttcacatcttacggcatttcttgggtacggcaggcaccggggcagggtttggaatggatggggtggatttccgcctataacggccacacaaattacgcgcagaaattccaggggcgcgttacgatgacacgcgatacctctacctctaccgtttatatggaacttagtagtcttcgttcggaggataccgctgtctactattgcgcacgtgacagtgtacggggttgggactactactacggcatgggggtctggggccaagggaccactgtcaccgtctcctca

SEQ ID NO: 1089 - DNA, 360 bp, Artificial Sequence
  NK77.56_CD70_DB03_G06_VH_DNA
caggtgcagctggtgcagtctggggctgaggtgaagaagcctgggtcttcagtgaaggtttcctgcaaggcatctggatacaccttcatcgactactatatgcactgggtgcgacaggcccctggacaagggcttgagtggatgggatggatgaaccctcacagtggtaacagtgataatgcaccgaagttccagggcagagtcaccatcaccgcagacgagtccacgagcacagcatacatggagctgagcagcctgagatctgaggacacggccgtgtattactgtgctagaggttactccggatacgatctgacggctgactactggggccaagggaccctggtcaccgtctcctca

SEQ ID NO: 1090 - DNA, 387 bp, Artificial Sequence
  NK77.57_CD70_DB03_G11_VH_DNA
caggtgcagctggtgcagtctggggctgaggtgaagaagcctggggcctcagtgaaggtctcctgcaaggcttctggatacaccttcaccggccagtatatgcactgggtgcgacaggcccctggacaagggcttgagtggatgggatggatcaacccgaacactggtgacacaaactatgcacagaagtttcagggcagggtcaccatgaccagggacacgtccaccagcacagtatacatggagctgagcagcctgagatctgaagacacggccgtgtattactgtgcgagagacagcgttttcgaggttgaagggggtactgattattattattactacggtatggatgtctggggccaagggacaatggtcaccgtctcttca

SEQ ID NO: 1091 - DNA, 357 bp, Artificial Sequence
  NK77.58_CD70_DB03_H08_VH_DNA
caggtgcagctggtgcagtctggggctgaggtgaagaagcctggggcctcagtgaaggtttcctgcaaggcatctggatacaccttcaccagctacgacattaattgggtgcgacaggcccctggacaagggcttgagtggatgggagtgatcaaccctagtggtggaggtacaagctacgcacagaagttccagggcagagtcaccatgaccagggacacgtccacgagcacagtctacatggagctgagcagcctgagatctgaggacacggccgtgtattactgtgctagatattctggctatgattgggtgtttgactactggggccaagggaccctggtcaccgtctcctca

SEQ ID NO: 1092 - DNA, 360 bp, Artificial Sequence
  NK77.59_CD70_DB03_H10_VH_DNA
caggtgcagctggtgcagtctggggctgaggtgaagaagcctggggcctcagtgaaggtttcctgcaaggcatctggatacaccttcgctaactactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgctagagatagcggctcctactttggttggttcgacccctggggccagggaaccctggtcaccgtctcctca

SEQ ID NO: 1093 - DNA, 360 bp, Artificial Sequence
  NK77.60_CD70_DB04_A05_VH_DNA
caggtgcagctggtgcagtctggggctgaggtgaagaagcctggggcctcagtgaaggtttcctgcaaggcatctggatacaccttcaccacatactatatgcactgggtgcgacaggcccctggacaagggcttgagtggatgggaataatcaaccctaccggcggtagcacatactacgcacagaagttccagggcagagtcaccatgaccagggacacgtccacgagcacagtctacatggagctgagcagcctgagatctgaggacacggccgtgtattactgtgctagagacagcgggaactatcaagggatctttgactactggggccaagggaccctggtcaccgtctcctca

SEQ ID NO: 1094 - DNA, 357 bp, Artificial Sequence
  NK77.61_CD70_DB04_A07_VH_DNA
caggtgcagctggtgcagtctggggctgaggtgaagaagcctggggcctcagtgaaggtttcctgcaaggcatctggaaataccttcaccagctactatatgcactgggtgcgacaggcccctggacaagggcttgagtggatgggatggatcaaccccaacagtggtgacacaaattacgcacagaacttccagggcagagtcaccatgaccagggacacgtccacgagcacagtctacatggagctgagcagcctgagatctgaggacacggccgtgtattactgtgctagaggtgtcagcggttacgatctatttgactactggggccaagggaccctggtcaccgtctcctca

SEQ ID NO: 1095 - DNA, 342 bp, Artificial Sequence
  NK77.62_CD70_DB04_A10_VH_DNA
gaggtgcagctggtggagtctgggggaggcttggtcaagcctggggggtccctgagactctcctgtgcagcgtctggattcaccttcagtagctatggcatgcactgggtccgccaggctccaggcaaggggctggagtgggtggcatcgataaaacatgatggaagtgagcaatactatgttgactccgtgaagggccgattcaccatctccagagacgattccaagaacacgctgtatctgcaaatgaacagcctgaaaacggaggacacggctgtgtattactgtgcggctagtggagtggatgtctggggccaagggacaaccgtcaccgtctcttca

SEQ ID NO: 1096 - DNA, 366 bp, Artificial Sequence
  NK77.63_CD70_DB04_A11_VH_DNA
caggtgcagctggtgcagtctggggctgaggtgaagaagcctggggcctcagtgaaggtttcctgcaaggcatctggaggtaccttcagtcgttacgacattaattgggtgcgacaggcccctggacaagggcttgagtgggtgggaataatcgatcctacaggtgcgtcaacaagctacgcacagaagttccagggcagagtcaccatgaccagggacacgtccacgagcacagtctacatggagctgagcagcctgagatctgaggacacggccgtgtattactgtgctagagattacagttacgggatggattattatggcatggacgtctggggccaagggaccctggtcaccgtctcctca

SEQ ID NO: 1097 - DNA, 357 bp, Artificial Sequence
  NK77.64_CD70_DB04_B03_VH_DNA
caggtgcagctggtgcagtctggggctgaggtgaagaagcctgggtcctcggtgaaggtctcctgcaaggcttctggatacaccttcaccagctatggaatcagctgggtgcgacaggcccctggacaagggcttgagtggatgggaggtatcatccctatctttggtacaacgaactacgcacagaagttccagggcagagtcacgattaccgcggacgaatccacgagcacagcctacatggagctgagcagcctgagatctgaggacacggccgtgtattactgtgcgagagatcatagcggcgatgggtacttcgatctctggggccgtggcaccctggtcactgtctcctca

SEQ ID NO: 1098 - DNA, 354 bp, Artificial Sequence
  NK77.65_CD70_DB04_B05_VH_DNA
caggtgcagctggtgcagtctggggctgaggtgaagaagcctggggcctcagtgaaggtctcctgcaaggcttctggatacaccttcaccgagaatgagatgcactgggtgcgacaggcccctggacaagggcttgagtggatgggatggatcaacccgaacagtggtggcacaaactatgcacagaagtttcagggcagggtcaccatgaccagggacacgtccactagcacagtgtacatggagctgagctctctgagatctgaagacacggccgtgtattactgtgcggggagctggggtggttactactttgactactggggccaagggaccctggtcaccgtctcctca

SEQ ID NO: 1099 - DNA, 363 bp, Artificial Sequence
  NK77.66_CD70_DB04_B07_VH_DNA
caggtgcagctggtgcagtctggggctgaggtgaagaagcctggggcctcagtgaaggtttcctgcaaggcatctggatacaccttcaccaactactatatctactgggtgcgacaggcccctggacaagggcttgagtggatgggatggatcaaccccaatgacggtgcaacaaattacgcacagaagttccagggcagagtcaccatgaccagggacacgtccacgagcacagtctacatggagctgagcagcctgagatctgaggacacggccgtgtattactgtgctagagaaggcaacgattactattattatttcatggactactggggccaagggaccctggtcaccgtctcctca

SEQ ID NO: 1100 - DNA, 366 bp, Artificial Sequence
  NK77.67_CD70_DB04_C01_VH_DNA
caggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggaggaatcacaccaatgtttggtacaacggactacgcacagaagttccagggcagagtcacgattaccgcggacgaatccacgagcacagcctacatggagctgagcagcctgagatctgaggacacggccgtgtattactgtgcgagagatgagcgggacggatacgccacagtggcttttgatatctggggccaagggacaatggtcaccgtctcttca

SEQ ID NO: 1101 - DNA, 366 bp, Artificial Sequence
  NK77.68_CD70_DB04_C04_VH_DNA
caggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtgacggaggaacaagctacgcagacaagttccagggcagagtcaccatgaccagggacacgtccacgagcacagtctacatggagctgagcagcctgagatctgaggacacggccgtgtattactgtgctagagcgcttgcccccctgggatggggtgacggcatggatgtctggggccaagggacaacagtcaccgtctcttca

SEQ ID NO: 1102 - DNA, 357 bp, Artificial Sequence
  NK77.69_CD70_DB04_C06_VH_DNA
caggtgcagctggtgcagtctggggctgaggtgaagaagcctgggtcctcggtgaaggtctcctgcaaggcttctggatacaccttcactagctattacatccactgggtgcgacaggcccctggacaagggcttgagtggatgggatggatgaatccctcctcaggtgttacgaacttcgcacagaagttccagggcagagtcacgattaccgcggacgaatccacgagcacagcctacatggagctgagcagcctgagatctgaggacacggccgtgtattactgtgcgagaggttcggaccagggtgactggtctgacccctggggccagggaaccctggtcaccgtctcctca

SEQ ID NO: 1103 - DNA, 366 bp, Artificial Sequence
  NK77.70_CD70_DB04_C07_VH_DNA
caggtgcagctggtgcagtctggggctgaggtgaagaagcctggggcctcagtgaaggtttcctgcaaggcatctggatacaccttcaccgactcctatatacactgggtgcgacaggcccctggacaagggcttgagtggattggatggatgaaccctaatacaggtgacacaggctacgcacagaagttccagggcagagtcaccatgaccagggacacgtccacgagcacagtctacatggagctgagcagcctgagatctgaggacacggccgtgtattactgtgctaaggacgactttggagagcttgctccagccaccttcgacccctggggccagggaaccctggtcaccgtctcctca

SEQ ID NO: 1104 - DNA, 366 bp, Artificial Sequence
  NK77.71_CD70_DB04_D02_VH_DNA
caggtgcagctggtgcagtctggggctgaggtgaagaagcctggggcctcagtgaaggtttcctgcaaggcatctggatacaccttcaccagctacgacatcaattgggtgcgacaggcccctggacaagggcttgagtggatgggagtcatcagccctagtggtggtggaacaagctacgcacagaagttccagggcagagtcaccatgaccagggacacgtccacgagcacagtctacatggagctgagcagcctgagatctgaggacacggccgtgtattactgtgctagatactacggcggcaaccccgaagggtggtacttcgatctctggggccgtggcaccctggtcactgtctcctca

SEQ ID NO: 1105 - DNA, 396 bp, Artificial Sequence
  NK77.72_CD70_DB04_D05_VH_DNA
gaggtgcagctgctggagtctgggggaggcctcgtccagcctgggggctccctgagactctcctgtgcagcctctggattcgttttcgatgactatgctatccactgggtccgccaggctccgggcaaggggctagagtgggtggcagcgatatcatatgatggaagtaataaatactacgcagactccgtgaagggccgattcaccatctccagagacaattccaagaacacgctgtatctgcaaatgaacagcctgagagctgaggacacggctgtgtattactgtgcgagagctccacaatattatgggagtggcaccgacccacttgaggttagatactactactacggcatggacgtgtggggccaagggaccacggtcaccgtctcctca

SEQ ID NO: 1106 - DNA, 366 bp, Artificial Sequence
  NK77.73_CD70_DB04_D07_VH_DNA
caggtgcagctggtgcagtctggggctgaggtgaagaagcctgggtcctcggtgaaggtctcctgcaaggcttctggaggcaccttccgcaattatgctatcagctgggtgcgacaggcccctggacaagggcttgagtggatgggaggtatcatccctatctttggtacagcaaactacgcacagaagttccagggcagagtcacgattaccgcggacgaatccacgagcacagcctacatggagctgagcagcctgagatctgaggacacggccgtgtattactgtgcgagagatcacagtgctgggactcaccacgacgcttttgatatctggggccaagggacaatggtcaccgtctcttca

SEQ ID NO: 1107 - DNA, 351 bp, Artificial Sequence
  NK77.74_CD70_DB04_D08_VH_DNA
caggtgcagctggtgcagtctggggctgaggtgaagaagcctggggcctcagtgaaggtctcctgcaaggcttctggatacaccttcaccagttattatatccactgggtgcgacaggccccgggacaagggcttgagtggatgggatggatgaacccaaacagtggtaacgccggctatgcacagaagttccagggcagagtcaccatgaccagggatacctccacaagcacagtgtacatggagctgagcagcctgagatctgaggacacggccgtgtattactgtgcgagagagtactgggggagctttgactactggggccaagggaccctggtcaccgtctcctca

SEQ ID NO: 1108 - DNA, 354 bp, Artificial Sequence
  NK77.75_CD70_DB04_D10_VH_DNA
caggtgcagctggtgcagtctggggctgaggtgaagaagcctggggcctcagtgaaggtttcctgcaaggcatctggatacaccttcaccggctactatatgcactgggtgcgacaggcccctggacaagggcttgagtggatgggaatgatcgatccaagcgacggtagcacaatttacgcacagaagttccagggcagagtcaccatgaccagggacacgtccacgagcacagtctacatggagctgagcagcctgagatctgaggacacggccgtgtattactgtgctagagagcggccactgtacgcttccgacctgtggggccaagggaccctggtcaccgtctcctca

SEQ ID NO: 1109 - DNA, 357 bp, Artificial Sequence
  NK77.85_CD70_DB03_B02_VH_DNA
caggtgcagctggtgcagtctggggctgaggtgaagaagcctgggtcttcagtgaaggtttcctgcaaggcatctggatacaccttcaccaactactatatgcactgggtgcgacaggcccctggacaagggcttgagtggatgggatggatgaaccccgatagtggtaatacagggtacgcacagaagttccagggcagagtcaccatcaccgctgacgaatccacgagcacagcctacatggagctgagcagcctgagatctgaggacacggccgtgtattactgtgctagaagtagcagctcctggcctgacttcgatctctggggccgtggcaccctggtcactgtctcctca

SEQ ID NO: 1110 - DNA, 360 bp, Artificial Sequence
  NK77.86_CD70_DB04_A06_VH_DNA
caagtccaactcgtacaatccggcgcagaagtcaaaaaacccggcgcaagcgtcaaggtatcatgtaaagctagcgggtatacatttacatcctattccatgcattgggtacgccaagctccaggccagggcctggaatgggtcggtatcattaatcccagttccggctctgccagttatgcgcaaaaatttcaaggaagggtgacaatgactcgagataccagtacctccactgtgtatatggaactgtcctcactaaggagcgaagatactgctgtatactactgcgcacgcgaacgtggggcctatagtagtaccttcgactattggggtcagggcacgttagtgacagtgtcttcc

SEQ ID NO: 1111 - DNA, 360 bp, Artificial Sequence
  NK77.87_CD70_DB04_A09_VH_DNA
caggtgcagctggtgcagtctggggctgaggtgaagaagcctggggcctcagtgaaggtttcctgcaaggcatctggatacaccttcaccgactactatatgcactgggtgcgacaggcccctggacaagggcttgagtggatgggagtcatcaacccctctgatggtacagctcattacgcacagcggctgcagggcagagtcaccatgaccagggacacgtccacgagcacagtctacatggagctgagcagcctgagatctgaggacacggccgtgtattactgtgctagagacagcggatcttactacgctgactttgactactggggccaagggaccctggtcaccgtctcctca

SEQ ID NO: 1112 - DNA, 321 bp, Artificial Sequence
  NK77.1_CD70_DB01_C03_VL_DNA
gacatccagatgacccagtctccatcctccctgtctgcatctgtaggagacagagtcaccatcacttgccgggcaagtcagaatattggcacatatttagcttggtatcagcagaaaccagggaaagcccctaagctcctgatctatgacgcatccaacttggagactggggtcccatcaaggttcagtggcagtggatctgggacagatttcactctcaccatcagcagtctgcaacctgaagattttgcaacttactactgtcaacagagttacagaatccctctcaccttcggccaagggacacgactggagattaaa

SEQ ID NO: 1113 - DNA, 321 bp, Artificial Sequence
  NK77.2_CD70_DB01_D02_VL_DNA
gacatccagatgacccagtctccatcctccctgtctgcatctgtaggagacagagtcaccatcacttgccgggcgagtcagaggattagcaattggttagcctggtatcagcagaaaccagggaaagcccctaagctcctgatctatgatgcatccaacttggaaaccggggtcccatccaggttcagtggcagtggatctgggacggattttactctcaccatcagcagcctgcagcctgaagattttgcaacttattactgtcaacagacctatagtcctccccctacttttggccaggggaccaagctggagatcaaa

SEQ ID NO: 1114 - DNA, 336 bp, Artificial Sequence
  NK77.3_CD70_DB01_E06_VL_DNA
gatattgtgatgactcagtctccactctccctgcccgtcacccctggagagccggcctccatctcctgcaggtctagtcagagcctcctgcactctaacggatacaactatttggattggtacctgcagaagccagggcagtctccacagctcctgatctatgcagcctcttcattacaatccggggtccctgacaggttcagtggcagtggatcaggcacagattttacactgaaaatcagcagagtggaggctgaggatgttggggtttattactgcatgcaagctctacaaactcctatcaccttcggccaagggacacgactggagattaaa

SEQ ID NO: 1115 - DNA, 321 bp, Artificial Sequence
  NK77.4_CD70_DB01_G04_VL_DNA
gacatccagatgacccagtctccatcctccctgtctgcatctgtaggagacagagtcaccatcacttgccgggcaagtcaggacattgacacctatttagcctggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacacaacccctttcacgttcggccaagggaccaaggtggaaatcaaa

SEQ ID NO: 1116 - DNA, 321 bp, Artificial Sequence
  NK77.5_CD70_DB01_G05_VL_DNA
gacatccagatgacccagtctccatcctccctgtctgcatctgtaggagacagagtcaccatcacttgccaggcaagtcaggacattagcaactatttaaattggtatcagcagaaaccagggaaagcccctaagctcctgatctatgatgcatccagtttggaaagtggggtcccatcaaggttcagtggcagtggatctgggacagatttcactctcaccatcagcagtctgcaacctgaagattttgcaacttactactgtcaacagagttaccgatcacctctcactttcggcggagggaccaaggtggagatcaaa

SEQ ID NO: 1117 - DNA, 321 bp, Artificial Sequence
  NK77.6_CD70_DB01_G07_VL_DNA
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttgaccatcagcagcctgcagcctgaagattttgcaacatattactgtcaacaggcttataggtggcctatcaccttcggccaagggacacgactggagattaaa

SEQ ID NO: 1118 - DNA, 321 bp, Artificial Sequence
  NK77.7_CD70_DB01_G11_VL_DNA
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgatgcatcctacttggaaacaggggtcccatcaaggttcagtggcagtggatctgggacagatttcactctcaccatcagcagtctgcaacctgaagattttgcaacttactactgtcaacagagttacacaattcctcctacgttcggccaagggaccaaggtggaaatcaaa

SEQ ID NO: 1119 - DNA, 321 bp, Artificial Sequence
  NK77.9_CD70_DB02_A03_VL_DNA
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactctcaccatcagcagcctgcagcctgaagattttgcaacatattactgtcaacagagctattccacccctctcactttcggccaggggaccaaggtggagatcaaa

SEQ ID NO: 1120 - DNA, 336 bp, Artificial Sequence
  NK77.10_CD70_DB02_A04_VL_DNA
gatattgtgatgactcagtctccactctccctgcccgtcacccctggagagccggcctccatctcctgcaggtctagtcagagcctcctgcattccaacggatacaactatttggattggtacctgcagaagccagggcagtctccacagctcctgatctatcaggcatctagcctggagtccggggtccctgacaggttcagtggcagtggatcaggcacagattttacactgaaaatcagcagagtggaggctgaggatgttggggtttattactgcatgcaaggaacgcactggcctccaactttcggcggagggaccaaggtggagatcaaa

SEQ ID NO: 1121 - DNA, 318 bp, Artificial Sequence
  NK77.11_CD70_DB02_A05_VL_DNA
gacatccagatgacccagtctccatcctccctgtctgcatctgtaggagacagagtcaccatcacttgccaagcaagtcaggacattagcaactatttaaattggtatcagcagaaaccagggaaagcccctaagctcctgatctatgctacctccaccttggctaacggggtcccatcaaggttcagtggcagtggatctgggacagatttcactctcaccatcagcagtctgcaacctgaagattttgcaacttactactgtcaacagagttacagtacgcttaccttcggccaagggacacgactggagattaaa

SEQ ID NO: 1122 - DNA, 321 bp, Artificial Sequence
  NK77.12_CD70_DB02_A06_VL_DNA
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactctgaccatcagcagcctgcagcctgaagattttgcaacatattactgtcaacagtcttacagtacgcctcctacgttcggccaagggaccaaggtggaaatcaaa

SEQ ID NO: 1123 - DNA, 321 bp, Artificial Sequence
  NK77.13_CD70_DB02_A07_VL_DNA
gacatccagatgacccagtctccatcctccctgtctgcatctgtaggagacagagtcaccatcacttgccgggcaagtcagagcattgacaattggttagcgtggtatcagcagaaaccagggaaagcccctaagctcctgatctatgctgcatccacattgcaaagtggggtcccatcaaggttcagtggcagtggatctgggacagatttcactctcaccatcagcagtctgcaacctgaagattttgcaacttactactgtcaacagagttacgatagtcctcccacttttggccaggggaccaagctggagatcaaa

SEQ ID NO: 1124 - DNA, 321 bp, Artificial Sequence
  NK77.14_CD70_DB02_A08_VL_DNA
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttgaccatcagcagcctgcagcctgaagattttgcaacatattactgtcaacagtcctatagcacccctctcactttcggcggagggaccaaggtggagatcaaa

SEQ ID NO: 1125 - DNA, 321 bp, Artificial Sequence
  NK77.15_CD70_DB02_A09_VL_DNA
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgtgtccaatttggaaacaggggtcccatcaaggttcagtggaagtggatctgggacagattttactctcaccatcagcagcctgcagcctgaagattttgcaacatattactgtcaacaggctaattccttccctctcactttcggcggagggaccaaggtggagatcaaa

SEQ ID NO: 1126 - DNA, 321 bp, Artificial Sequence
  NK77.16_CD70_DB02_A11_VL_DNA
gacatccagatgacccagtctccatcctccctgtctgcatctgtaggagacagagtcaccatcacttgccgggcaagtcagaccattagcaattatttaaattggtatcagcagaaaccagggaaagcccctaagctcctgatctatgacgcatccagtttggaaagtggggtcccatcaaggttcagtggcagtggatctgggacagatttcactctcaccatcagcagtctgcaacctgaagattttgcaacttactactgtcaacaggcaatcagttttcctctcactttcggcggagggaccaaggtggagatcaaa

SEQ ID NO: 1127 - DNA, 321 bp, Artificial Sequence
  NK77.17_CD70_DB02_B06_VL_DNA
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgacgcatccaatttggccaccggggtcccatcaaggttcagtggcagtggatctgggacagatttcactctcaccatcagcagtctgcaacctgaagattttgcaacttactactgtcaacagagtgatagttcacctctcactttcggccaagggaccaaggtggagatcaaa

SEQ ID NO: 1128 - DNA, 321 bp, Artificial Sequence
  NK77.18_CD70_DB02_B09_VL_DNA
gacatccagatgacccagtctccatcctccctgtctgcatctgtaggagacagagtcaccatcacttgccaggcaagtcaggacattagcaattatttaaattggtatcagcagaaaccagggaaagcccctaagctcctgatctatggtgcaacgacattgcaaagtggggtcccatcaaggttcagtggcagtggatctgggacagatttcactctcaccatcagcagtctgcaacctgaagattttgcaacttactactgtcaacaggcggatagttttccttacacttttggccaggggaccaagctggagatcaaa

SEQ ID NO: 1129 - DNA, 321 bp, Artificial Sequence
  NK77.19_CD70_DB02_C03_VL_DNA
gacatccagatgacccagtctccatcctccctgtctgcatctgtaggagacagagtcaccatcacttgcagggcgagtcagactattgacatctatttaaattggtatcagcagaaaccagggaaagcccctaagctcctgatctacgatgcatccaatttggaaacaggggtcccatcaaggttcagtggaagtggatctgggacagattttactttgaccatcagcagcctgcagcctgaagattttgcaacatattactgtcaacaggcagattccttccctctcactttcggcggagggaccaaggtggagatcaaa

SEQ ID NO: 1130 - DNA, 321 bp, Artificial Sequence
  NK77.20_CD70_DB02_C04_VL_DNA
gacatccagatgacccagtctccatcttctctgtctgcatctgtaggagacagagtcaccatcacttgtcgggcgagtcagggtattagcaacaacttaaattggtatcagcagaaaccagggaaagcccctaagctcctgatctatgctgcatccagtttgcacagtggggtcccatcaaggttcagcggcagtggatctgggacagatttcactctcactatcagcagcctgcagcctgaagattttgcaacttactattgtcaacaggctgatgctttccctctcactttcggcggagggaccaaggtggagatcaaa

SEQ ID NO: 1131 - DNA, 321 bp, Artificial Sequence
  NK77.22_CD70_DB02_C07_VL_DNA
gacatccagatgacccagtctccatcctccctgtctgcatctgtaggagacagagtcaccatcacttgccgggcaagtcagagcattggaacctggttagcctggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacaccacccctattacgttcggccaagggaccaaggtggaaatcaaa

SEQ ID NO: 1132 - DNA, 321 bp, Artificial Sequence
  NK77.24_CD70_DB02_D02_VL_DNA
gaaatagtgatgacgcagtctccagccaccctgtctgtgtctccaggggaaagagccaccctctcctgcagggccagtcagagtgttagcagctacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtatgatagctatcctccaactttcggcggagggaccaaggtggagatcaaa

SEQ ID NO: 1133 - DNA, 321 bp, Artificial Sequence
  NK77.25_CD70_DB02_D04_VL_DNA
gacatccagatgacccagtctccatcctccctgtctgcatctgtaggagacagagtcaccatcacttgccaggcaagtcaggacattagcaattatttaaattggtatcagcagaaaccagggaaagcccctaagctcctgatctatgctgcatccaccttggaaagtggggtcccatcaaggttcagtggcagtggatctgggacagatttcactctcaccatcagcagtctgcaacctgaagattttgcaacttactactgtcttcaggattacgactaccctctgacttttggccaggggaccaagctggagatcaaa

SEQ ID NO: 1134 - DNA, 321 bp, Artificial Sequence
  NK77.26_CD70_DB02_D10_VL_DNA
gacatccagatgacccagtctccatcttctctctctgcatctgtaggagacagagtcaccatcacttgtcgggcgagtcagacaatttataagtggttagcctggtatcagcagaaaccagggaaagcccctaagctcctgatctatgacgcatccagtttggaaagtggggtcccatcaaggttcagcggcagtggatctgggacagatttcactctcactatcagcagcctgcagcctgaagattttgcaacttactattgtcaacaggctaacagtttccctttcactttcggccctgggaccaaagtggatatcaaa

SEQ ID NO: 1135 - DNA, 321 bp, Artificial Sequence
  NK77.27_CD70_DB02_D11_VL_DNA
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactctgaccatcagcagcctgcagcctgaagatttcgcaacatattactgtcaacaggcccactcgtttcctcccacgttcggccaagggaccaaggtggaaatcaaa

SEQ ID NO: 1136 - DNA, 321 bp, Artificial Sequence
  NK77.28_CD70_DB02_E04_VL_DNA
gacatccagatgacccagtctccatcctccctgtctgcatctgtaggagacagagtcaccatcacttgccgggcaagtaccagcattagcgattatgtgcattggtatcagcagaaaccagggaaagcccctaagctcctgatctatgatgcatccagtttgcaaagtggggtcccatcaaggttcagtggcagtggatctgggacagatttcactctcaccatcagcagtctgcaacctgaagattttgcaacttactactgtcaacagagtgatagtacccctcccactttcggcggagggaccaaggtggagatcaaa

SEQ ID NO: 1137 - DNA, 321 bp, Artificial Sequence
  NK77.29_CD70_DB02_F06_VL_DNA
gacatccagatgacccagtctccatcctccctgtctgcatctgtaggagacagagtcaccatcacttgccgggcaagtcagggaattagcaataatttaaattggtatcagcagaaaccagggaaagcccctaagctcctgatctattacgcatccaccttgcaaagtggggtcccatcaaggttcagtggcagtggatctgggacagatttcactctcaccatcagcagtctgcaacctgaagattttgcaacttactactgtcaacagagttacagtacccctatcaccttcggccaagggacacgactggagattaaa

SEQ ID NO: 1138 - DNA, 321 bp, Artificial Sequence
  NK77.31_CD70_DB02_F08_VL_DNA
gacatccagatgacccagtctccatcctccctgtctgcatctgtaggagacagagtcaccatcacttgccgggcaagtcagacgattagcaattatttaaattggtatcagcagaaaccagggaaagcccctaagctcctgatctatgatgcatccacgttggaagccggggtcccatcaaggttcagtggcagtggatctgggacagatttcactctcaccatcagcagtctgcaacctgaagattttgcaacttactactgtcaacagagttacaaccctccatacacttttggccaggggaccaagctggagatcaaa

SEQ ID NO: 1139 - DNA, 321 bp, Artificial Sequence
  NK77.32_CD70_DB02_G07_VL_DNA
gacatccagatgacccagtctccatcctccctgtctgcatctgtaggagacagagtcaccatcacttgccgggcaagtcagagcattagcacttatttaaattggtatcagcagaaaccagggaaagcccctaagctcctgatctatgatgcatccaacttggagatcggggtcccatcaaggttcagtggcagtggatctgggacagatttcactctcaccatcagcagtctgcaacctgaagattttgcaacttactactgtcaacagagtgacagttcaccactcactttcggccaggggaccaaggtggagatcaaa

SEQ ID NO: 1140 - DNA, 321 bp, Artificial Sequence
  NK77.33_CD70_DB02_H04_VL_DNA
gacatccagatgacccagtctccatcctccctgtctgcatctgtaggagacagagtcaccatcacttgccaagcaagtcaggatattagcaactatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttaccggacccctctcactttcggcggagggaccaaggtggagatcaaa

SEQ ID NO: 1141 - DNA, 321 bp, Artificial Sequence
  NK77.34_CD70_DB02_H05_VL_DNA
gacatccagatgacccagtctccatcctccctgtctgcatctgtaggagacagagtcaccatcacttgccgggcaagtcaggatattcgcaacgatttagggtggtatcagcagaaaccagggaaagcccctaagctcctgatctatgctgcatccaacttggagaccggggtcccatcaaggttcagtggcagtggatctgggacagatttcactctcaccatcagcagtctgcaacctgaagattttgcaacttactactgtcaacagagttacagtgcacctttcactttcggccctgggaccaaagtggatatcaaa

SEQ ID NO: 1142 - DNA, 321 bp, Artificial Sequence
  NK77.35_CD70_DB02_H08_VL_DNA
gacatccagatgacccagtctccatcctccctgtctgcatctgtaggagacagagtcaccatcacttgccgggcaagtcaggagattagcaactatttagcctggtatcagcagaaaccagggaaagcccctaagctcctgatctatgatgcatccaacttgcaaactggggtcccatcaaggttcagtggcagtggatctgggacagatttcactctcaccatcagcagtctgcaacctgaagattttgcaacttactactgtcaacagagttacagtacccctttcactttcggccctgggaccaaagtggatatcaaa

SEQ ID NO: 1143 - DNA, 321 bp, Artificial Sequence
  NK77.36_CD70_DB03_A06_VL_DNA
gacatccagatgacccagtctccatcctccctgtctgcatctgtaggagacagagtcaccatcacttgccaggcaagtcaggacattagcgattctttaaattggtatcagcagaaaccagggaaagcccctaagctcctgatctattccgcatccagtttgcaaagtggggtcccatcaaggttcagtggcagtggatctgggacagatttcactctcaccatcagcagtctgcaacctgaagattttgcaacttactactgtcaacagagttttacaaccccttatacgttcggccaagggaccaaggtggaaatcaaa

SEQ ID NO: 1144 - DNA, 321 bp, Artificial Sequence
  NK77.37_CD70_DB03_A07_VL_DNA
gacatccagatgacccagtctccatcttctctgtctgcatctgtaggagacagagtcaccatcacttgtcgggcgagtcagtctattagcagctggttagcctggtatcagcagaaaccagggaaagcccctaagctcctgatctatgatgcatccaatttggaaacaggggtcccatcaaggttcagcggcagtggatctgggacagatttcactctcactatcagcagcctgcagcctgaagattttgcaacttactattgtcaacagaatttcagtcctcctctcaccttcggccaagggacacgactggagattaaa

SEQ ID NO: 1145 - DNA, 321 bp, Artificial Sequence
  NK77.38_CD70_DB03_A08_VL_DNA
gacatccagatgacccagtctccatcctccctgtctgcatctgtaggagacagagtcaccatcacttgccgggcaagtcaggacattcggcattatttagcatggtatcagcagaaaccagggaaagcccctaagctcctgatctatgacgcatccagtttgcaaagtggggtcccatcaaggttcagtggcagtggatctgggacagatttcactctcaccatcagcagtctgcaacctgaagattttgcaacttactactgtcaacagacctacgacgcacctatcaccttcggccaagggacacgactggagattaaa

SEQ ID NO: 1146 - DNA, 321 bp, Artificial Sequence
  NK77.39_CD70_DB03_A09_VL_DNA
gacatcgtgatgacccagtctccagactccctggctgtgtctctgggcgagagggccaccatcaactgccgggccagctctagtatttccaactacttagcttggtaccagcagaaaccaggacagcctcctaagctgctcatttacggcgcatctacccgggcttccggggtccctgaccgattcagtggcagcgggtctgggacagatttcactctcaccatcagcagcctgcaggctgaagatgtggcagtttattactgtcagcaaagctatagtactcctctcactttcggccaggggaccaaggtggagatcaaa

SEQ ID NO: 1147 - DNA, 321 bp, Artificial Sequence
  NK77.40_CD70_DB03_A11_VL_DNA
gacatccagatgacccagtctccatcctccctgtctgcatctgtaggagacagagtcaccatcacttgccgggcgagtcagggcattaccaattttttagcctggtatcagcagaaaccagggaaagcccctaagctcctgatatatgatgcatccaacttggaaaccggggtcccatccaggttcagtggcagtggatctgggacggatttcactctcaccatcagcagcctgcagcctgaagattttgcaacttattactgtcaacagagctatggggcccctcttaccttcggccaagggacacgactggagattaaa

SEQ ID NO: 1148 - DNA, 321 bp, Artificial Sequence
  NK77.41_CD70_DB03_A12_VL_DNA
gacatccagatgacccagtctccatcctccctgtctgcatctgtaggagacagagtcaccatcacttgccaagcaagtcaggacattagcaactatttaaattggtatcagcagaaaccagggaaagcccctaagctcctgatctattccgcatccaccttgcaaagtggggtcccatcaaggttcagtggcagtggatctgggacagatttcactctcaccatcagcagtctgcaacctgaagattttgcaacttactactgtcaacagagttacagttctccttatagattcggccaagggaccaaggtggaaatcaaa

SEQ ID NO: 1149 - DNA, 336 bp, Artificial Sequence
  NK77.42_CD70_DB03_B01_VL_DNA
gatattgtgatgactcagtctccactctccctgcccgtcacccctggagagccggcctccatctcctgcaggtctagtcagagcctcctccactctaatggctacaactatttggattggtacctgcagaagccagggcagtctccacagctcctgatctatgcagcttctagtctccagtccggggtccctgacaggttcagtggcagtggatcaggcacagattttacactgaaaatcagcagagtggaggctgaggatgttggggtttattactgcatgcaaggggcccattggcctccgacttttggccaggggaccaagctggagatcaaa

SEQ ID NO: 1150 - DNA, 321 bp, Artificial Sequence
  NK77.43_CD70_DB03_B04_VL_DNA
gacatccagatgacccagtctccatcctccctgtctgcatctgtaggagacagagtcaccatcacttgccgggcaagtcaggacattagggatgggttaggctggtatcagcagaaaccagggaaagcccctaagctcctgatctatgctgcatccactttgcaaagtggggtcccatcaaggttcagtggcagtggatctgggacagatttcactctcaccatcagcagtctgcaacctgaagattttgcaacttactactgtcaacagagttacgggacccctcctacgttcggccaagggaccaaggtggaaatcaaa

SEQ ID NO: 1151 - DNA, 318 bp, Artificial Sequence
  NK77.44_CD70_DB03_B06_VL_DNA
gaaatagtgatgacgcagtctccagccaccctgtctgtgtctccaggggaaagagccaccctctcctgcagggccagtcagagtgttagcagctatttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtatgattcctcccctacgttcggccaagggaccaaggtggaaatcaaa

SEQ ID NO: 1152 - DNA, 321 bp, Artificial Sequence
  NK77.45_CD70_DB03_B09_VL_DNA
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgatgcatccaacttggaaaccggggtcccatcaaggttcagtggcagtggatctgggacagatttcactctcaccatcagcagtctgcaacctgaagattttgcaacttactactgtcaacagagtcacagtgcgcctatcaccttcggccaagggacacgactggagattaaa

SEQ ID NO: 1153 - DNA, 321 bp, Artificial Sequence
  NK77.46_CD70_DB03_C05_VL_DNA
gacatccagatgacccagtctccatcctccctgtctgcatctgtaggagacagagtcaccatcacttgccgggcaagtcagagcattagcacaaacttagcttggtatcagcagaaaccagggaaagcccctaagctcctgatctatgatgcatcctatttggaggctggggtcccatcaaggttcagtggcagtggatctgggacagatttcactctcaccatcagcagtctgcaacctgaagattttgcaacttactactgtcaacagagttacagtacccctccgacttttggccaggggaccaagctggagatcaaa

SEQ ID NO: 1154 - DNA, 339 bp, Artificial Sequence
  NK77.47_CD70_DB03_D11_VL_DNA
gacatcgtgatgacccagtctccagactccctggctgtgtctctgggcgagagggccaccatcaactgcaagtccagccagagtgttttatattccagtaataacaagaactacttagcttggtaccagcagaaaccaggacagcctcctaagctgctcatttactgggcatctacccgggattccggggtccctgaccgattcagtggcagcgggtctgggacagatttcactctcaccatcagcagcctgcaggctgaagatgtggcagtttattactgtcagcaatattatggcttccctcccaccttcggccaagggacacgactggagattaaa

SEQ ID NO: 1155 - DNA, 321 bp, Artificial Sequence
  NK77.48_CD70_DB03_E01_VL_DNA
gacatccagatgacccagtctccatcctccctgtctgcatctgtaggagacagagtcaccatcacttgccaagcaagtcacgacattagcaaattcttaaattggtatcagcagaaaccagggaaagcccctaagctcctgatctatgatgcatccaatttgcaacgaggggtcccatcaaggttcagtggcagtggatctgggacagatttcactctcaccatcagcagtctgcaacctgaagattttgcaacttactactgtcaacagacctacagtttccctttcacttttggccaggggaccaagctggagatcaaa

SEQ ID NO: 1156 - DNA, 336 bp, Artificial Sequence
  NK77.49_CD70_DB03_E03_VL_DNA
gatattgtgatgactcagtctccactctccctgcccgtcacccctggagagccggcctccatctcctgcaggtctagtcagagcctcctccattcaaacgggtacaactatttggattggtacctgcagaagccagggcagtctccacagctcctgatctatgatgcctcttcccttcagtccggggtccctgacaggttcagtggcagtggatcaggcacagattttacactgaaaatcagcagagtggaggctgaggatgttggggtttattactgcatgcaagctcggcaaactcctctgaccttcggccaagggacacgactggagattaaa

SEQ ID NO: 1157 - DNA, 336 bp, Artificial Sequence
  NK77.50_CD70_DB03_E09_VL_DNA
gatattgtgatgactcagtctccactctccctgcccgtcacccctggagagccggcctccatctcctgcaggtctagtcagagcctcctgcattcaaatggttacaactatttggattggtacctgcagaagccagggcagtctccacagctcctgatctatgctgcttctaatttacagggtggggtccctgacaggttcagtggcagtggatcaggcacagattttacactgaaaatcagcagagtggaggctgaggatgttggggtttattactgcatgcaaacactagagtcccctgtaactttcggcggagggaccaaggtggagatcaaa

SEQ ID NO: 1158 - DNA, 321 bp, Artificial Sequence
  NK77.51_CD70_DB03_F02_VL_DNA
gacatccagatgacccagtctccatcctccctgtctgcatctgtaggagacagagtcaccatcacttgccgggcaagtcagggcattagcaacaatttaaattggtatcagcagaaaccagggaaagcccctaagctcctgatctatgatgcatccaacttggaacgtggggtcccatcaaggttcagtggcagtggatctgggacagatttcactctcaccatcagcagtctgcaacctgaagattttgcaacttactactgtcaacagagttacgacggtcctatcaccttcggccaagggacacgactggagattaaa

SEQ ID NO: 1159 - DNA, 321 bp, Artificial Sequence
  NK77.52_CD70_DB03_F05_VL_DNA
gacatccagatgacccagtctccatcctccctgtctgcatctgtaggagacagagtcaccatcacttgccgggcaagtcagagcattagcagctggttagcttggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtttgcaggactacagttatcctctcactttcggcggagggaccaaggtggagatcaaa

SEQ ID NO: 1160 - DNA, 321 bp, Artificial Sequence
  NK77.53_CD70_DB03_F06_VL_DNA
gacatccagatgacccagtctccatcctccctgtctgcatctgtaggagacagagtcaccatcacttgccgggcaagtcagagcattaacaggtggttagcgtggtatcagcagaaaccagggaaagcccctaagctcctgatctatgacgcatccaatttggagaccggggtcccatcaaggttcagtggcagtggatctgggacagatttcactctcaccatcagcagtctgcaacctgaagattttgcaacttactactgtcaacagagttacattacccctctcactttcggcggagggaccaaggtggagatcaaa

SEQ ID NO: 1161 - DNA, 321 bp, Artificial Sequence
  NK77.54_CD70_DB03_F09_VL_DNA
gacatccagatgacccagtctccatcctccctgtctgcatctgtaggagacagagtcaccatcacttgccaggcaagtcaggatattagcaactatttaaattggtatcagcagaaaccagggaaagcccctaagctcctgatctatgacgcatccagtttggaaagtggggtcccatcaaggttcagtggcagtggatctgggacagatttcactctcaccatcagcagtctgcaacctgaagattttgcaacttactactgtcaacagactaatagttttcctatcaccttcggccaagggacacgactggagattaaa

SEQ ID NO: 1162 - DNA, 321 bp, Artificial Sequence
  NK77.55_CD70_DB03_F12_VL_DNA
gacatccagatgacccagtctccatcctccctgtctgcatctgtaggagacagagtcaccatcacttgccaggcaagtcaggacattagaaacttcttaaattggtatcagcagaaaccagggaaagcccctaagctcctgatctatgctgcatccacgttgcaaagtggggtcccatcaaggttcagtggcagtggatctgggacagatttcactctcaccatcagcagtctgcaacctgaagattttgcaacttactactgtcaacagagttacagtgcccctagcacttttggccaggggaccaagctggagatcaaa

SEQ ID NO: 1163 - DNA, 321 bp, Artificial Sequence
  NK77.56_CD70_DB03_G06_VL_DNA
gacatccagatgacccagtctccatcctccctgtctgcatctgtaggagacagagtcaccatcacttgccgggcaagtcagagcattagcaattatttaaattggtatcagcagaaaccagggaaagcccctaagctcctgatctatgacgcatccaacttggagaccggggtcccatcaaggttcagtggcagtggatctgggacagatttcactctcaccatcagcagtctgcaacctgaagattttgcaacttactactgtcaacagagttacagtacccctatcaccttcggccaagggacacgactggagattaaa

SEQ ID NO: 1164 - DNA, 321 bp, Artificial Sequence
  NK77.57_CD70_DB03_G11_VL_DNA
gacatccagatgacccagtctccatcctccctgtctgcatctgtaggagacagagtcaccatcacttgccgggcaagtgaaaccattagcggctggttagcctggtatcagcagaaaccagggaaagcccctaagctcctgatctatgacgcatccaacttggagactggggtcccatcaaggttcagtggcagtggatctgggacagatttcactctcaccatcagcagtctgcaacctgaagattttgcaacttactactgtcaacagagttacagtaccccttggacgttcggccaagggaccaagctggaaatcaaa

SEQ ID NO: 1165 - DNA, 321 bp, Artificial Sequence
  NK77.58_CD70_DB03_H08_VL_DNA
gacatccagatgacccagtctccatcctccctgtctgcatctgtaggagacagagtcaccatcacttgccgggcaagtcagggcattggcagctggttagcttggtatcagcagaaaccagggaaagcccctaagctcctgatctatgctgcatccacattgcaaagtggggtcccatcaaggttcagtggcagtggatctgggacagatttcactctcaccatcagcagtctgcaacctgaagattttgcaacttactactgtcaacagagttacagtaccccttggactttcggccctgggaccaaagtggatatcaaa

SEQ ID NO: 1166 - DNA, 321 bp, Artificial Sequence
  NK77.59_CD70_DB03_H10_VL_DNA
gacatccagatgacccagtctccatcctccctgtctgcatctgtaggagacagagtcaccatcacttgccgggcaagtcagagcattagcagctctttagcatggtatcagcagaaaccagggaaagcccctaagctcctgatctatgatgcatccagtttgcaaagtggggtcccatcaaggttcagtggcagtggatctgggacagatttcactctcaccatcagcagtctgcaacctgaagattttgcaacttactactgtcaacagagttacaacacccctcccactttcggcggagggaccaagctggagatcaaa

SEQ ID NO: 1167 - DNA, 321 bp, Artificial Sequence
  NK77.60_CD70_DB04_A05_VL_DNA
gacatccagatgacccagtctccatcctccctgtctgcatctgtaggagacagagtcaccatcacttgccgggcaagtcaggggattggcggctatttagcctggtatcagcagaaaccagggaaagcccctaagctcctgatctatgatgcatccaatttggagaccggggtcccatcaaggttcagtggcagtggatctgggacagatttcactctcaccatcagcagtctgcaacctgaagattttgcaacttactactgtcaacagagttacgactcccctcccaccttcggccaagggacacgactggagattaaa

SEQ ID NO: 1168 - DNA, 321 bp, Artificial Sequence
  NK77.61_CD70_DB04_A07_VL_DNA
gacatccagatgacccagtctccatcctccctgtctgcatctgtaggagacagagtcaccatcacttgccgggcaagtcagagcgtgagcagctatttaaattggtatcagcagaaaccagggaaagcccctaagctcctgatctatgatacgtccaacttggagacgggggtcccatcaaggttcagtggcagtggatctgggacagatttcactctcaccatcagcagtctgcaacctgaagattttgcaacttactactgtcaacaggctcatagttttcctctcactttcggcggagggaccaaggtggagatcaaa

SEQ ID NO: 1169 - DNA, 336 bp, Artificial Sequence
  NK77.62_CD70_DB04_A10_VL_DNA
gatattgtgatgactcagtctccactctccctgcccgtcacccctggagagccggcctccatctcctgcaggtctagtcagagcctcctgcacagcaatggctacaactatttggattggtacctgcagaagccagggcagtctccacagctcctgatctatttgggttctacccgggcctccggggtccctgacaggttcagtggcagtggatcaggcacagattttacactgaaaatcagcagagtggaggctgaggatgttggggtttattactgcatgcaagctctagatactcctctcactttcggcggagggaccaagttagagatcaaa

SEQ ID NO: 1170 - DNA, 321 bp, Artificial Sequence
  NK77.63_CD70_DB04_A11_VL_DNA
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatacctccaatttgcagacaggggtcccatcaaggttcagtggaagtggatctgggacagattttactcttaccatcagcagcctgcagcctgaagattttgcaacatattacctgagcacagatctgcagaccaccgctcacttcggccaagggaccaaggtggaaatcaaa

SEQ ID NO: 1171 - DNA, 336 bp, Artificial Sequence
  NK77.64_CD70_DB04_B03_VL_DNA
gatattgtgatgactcagtctccactctccctgcccgtcacccctggagagccggcctccatctcctgcaggtctagtcagagcctcctgcactccaacggatacaactatttggattggtacctgcagaagccagggcagtctccacagctcctgatctatgatgcctcttcacttcagtccggggtccctgacaggttcagtggcagtggatcaggcacagattttacactgaaaatcagcagagtggaggctgaggatgttggggtttattactgcatgcaaggaacacactggcctcccacgttcggccaagggaccaaggtggaaatcaaa

SEQ ID NO: 1172 - DNA, 321 bp, Artificial Sequence
  NK77.65_CD70_DB04_B05_VL_DNA
gacatccagatgacccagtctccatcctccctgtctgcatctgtaggagacagagtcaccatcacttgccgggcaagtcagagcgttagcagatatttaaattggtatcagcagaaaccagggaaagcccctaagctcctgatctatgatgcatccaatttggaaaccggggtcccatcaaggttcagtggcagtggatctgggacagatttcactctcaccatcagcagtctgcaacctgaagattttgcaacttactactgtcaacaggccgacagtttccctgtgacttttggccaggggaccaagctggagatcaaa

SEQ ID NO: 1173 - DNA, 321 bp, Artificial Sequence
  NK77.66_CD70_DB04_B07_VL_DNA
gacatccagatgacccagtctccatcctccctgtctgcatctgtaggagacagagtcaccatcacttgccgggcaagtcagggcattagcaacaatttaaattggtatcagcagaaaccagggaaagcccctaagctcctgatctatcatgcatccaacttggagacgggggtcccatcaaggttcagtggcagtggatctgggacagatttcactctcaccatcagcagtctgcaacctgaagattttgcaacttactactgtcaacagagttacgacggccctatgacttttggccaggggaccaagctggagatcaaa

SEQ ID NO: 1174 - DNA, 336 bp, Artificial Sequence
  NK77.67_CD70_DB04_C01_VL_DNA
gatattgtgatgactcagtctccactctccctgcccgtcacccctggagagccggcctccatctcctgcaggtctagtcagagcctcctgcatagcaatggatacaactatttggattggtacctgcagaagccagggcagtctccacagctcctgatctatgatgcttctaatcttgagacaggggtccctgacaggttcagtggcagtggatcaggcacagattttacactgaaaatcagcagagtggaggctgaggatgttggggtttattactgcatgcaagggacgcattggcctcccacgttcggccaagggaccaaggtggaaatcaaa

SEQ ID NO: 1175 - DNA, 321 bp, Artificial Sequence
  NK77.68_CD70_DB04_C04_VL_DNA
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactctcaccatcagcagcctgcagcctgaagatttcgcaacatattactgtcaacagtcatatgatggacctatcaccttcggccaagggacacgactggagattaaa

SEQ ID NO: 1176 - DNA, 321 bp, Artificial Sequence
  NK77.69_CD70_DB04_C06_VL_DNA
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgacgcatccaacttggaaacgggggtcccatcaaggttcagtggcagtggatctgggacagatttcactctcaccatcagcagtctgcaacctgaagattttgcaacttactactgtcaacagagttacaatacccctccaactttcggcggagggaccaaggtggagatcaaa

SEQ ID NO: 1177 - DNA, 321 bp, Artificial Sequence
  NK77.70_CD70_DB04_C07_VL_DNA
gacatccagatgacccagtctccatcctccctgtctgcatctgtaggagacagagtcaccatcacttgccaggcaagtcaggacattagcaattatttaaattggtatcagcagaaaccagggaaagcccctaagctcctgatctatggtgcatccagtttgcaaagtggggtcccatcaaggttcagtggcagtggatctgggacagatttcactctcaccatcagcagtctgcaacctgaagattttgcaacttactactgtctgcaggatgcggcgacccctatcaccttcggccaagggacacgactggagattaaa

SEQ ID NO: 1178 - DNA, 321 bp, Artificial Sequence
  NK77.71_CD70_DB04_D02_VL_DNA
gacatccagatgacccagtctccatcctccctgtctgcatctgtaggagacagagtcaccatcacttgccgggcaagtcagagcattggaaattggttagcctggtatcagcagaaaccagggaaagcccctaagctcctgatctatgacgcatccgatttggaaaccggggtcccatcaaggttcagtggcagtggatctgggacagatttcactctcaccatcagcagtctgcaacctgaagattttgcaacttactactgtcaacagagttacactaccccttggacgttcggccaagggaccaaggtggaaatcaaa

SEQ ID NO: 1179 - DNA, 336 bp, Artificial Sequence
  NK77.72_CD70_DB04_D05_VL_DNA
gatattgtgatgactcagtctccactctccctgcccgtcacccctggagagccggcctccatctcctgcaggtctagtcagagcctcttgcattctaatggctacaactatttggattggtacctgcagaagccagggcagtctccacagctcctgatctatgaagtctctaatcgggcctccggggtccctgacaggttcagtggcagtggatcaggcacagattttacactgaaaatcagcagagtggaggctgaggatgttggggtttattactgcatgaaaggcctacaaactcctctgactttcggccctgggaccaaagtggatatcaaa

SEQ ID NO: 1180 - DNA, 321 bp, Artificial Sequence
  NK77.73_CD70_DB04_D07_VL_DNA
gacatccagatgacccagtctccatcctccctgtctgcatctgtaggagacagagtcaccatcacttgccgggcaagtcagggcattagcaactatttagcctggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagtcacagtacccctctcactttcggccaagggaccaaggtggagatcaaa

SEQ ID NO: 1181 - DNA, 321 bp, Artificial Sequence
  NK77.74_CD70_DB04_D08_VL_DNA
gacatccagatgacccagtctccatcctccctgtctgcatctgtaggagacagagtcaccatcacttgccgggcaagtcaggggattagcaataacttaaattggtatcagcagaaaccagggaaagcccctaagctcctgatctatgatgcatccaacttggaaactggggtcccatcaaggttcagtggcagtggatctgggacagatttcactctcaccatcagcagtctgcaacctgaagattttgcaacttactactgtcaacagagttacagtaccccttatacgttcggccaagggaccaaggtggaaatcaaa

SEQ ID NO: 1182 - DNA, 321 bp, Artificial Sequence
  NK77.75_CD70_DB04_D10_VL_DNA
gatatccagatgacccagtctccatcctccctgtctgcatctgtaggagacagagtcaccatcacttgccgggcaagtcaggacattggaaatgatttaggctggtatcagcagaaaccagggaaagcccctaagctcctgatctatgctgcatccagtttacaaagtggggtcccatcaaggttcagcggcagtggatctggcacagatttcactctcaccatcagcagcctgcagcctgaagattttgcaacttattactgtctacaagattacgactaccctctcactttcggccaggggaccaaggtggagatcaaa

SEQ ID NO: 1183 - DNA, 321 bp, Artificial Sequence
  NK77.85_CD70_DB03_B02_VL_DNA
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgatgcatccaacttggagactggggtcccatcaaggttcagtggcagtggatctgggacagatttcactctcaccatcagcagtctgcaacctgaagattttgcaacttactactgtcaacagagttacaacaccccttacagttttggccaggggaccaaggtggagatcaaa

SEQ ID NO: 1184 - DNA, 321 bp, Artificial Sequence
  NK77.86_CD70_DB04_A06_VL_DNA
gacatccagatgacccagtctccatcctccctgtctgcatctgtaggagacagagtcaccatcacttgccggacaagtcagagcattagcagctatttaaattggtatcagcagaaaccagggaaagcccctaagctcctgatctatgacgcatccaatttggaaaccggggtcccatcaaggttcagtggcagtggatctgggacagatttcactctcaccatcagcagtctgcaacctgaagattttgcaacttactactgtcttcaggactacagttaccctctcactttcggccaagggaccaaggtggagatcaaa

SEQ ID NO: 1185 - DNA, 321 bp, Artificial Sequence
  NK77.87_CD70_DB04_A09_VL_DNA
gacatccagatgacccagtctccatcctccctgtctgcatctgtaggagacagagtcaccatcacttgccaggcaagtcaggacattagcaattatttaaattggtatcagcagaaaccagggaaagcccctaagctcctgatctatgatgcatccagtttgcaaagtggggtcccatcaaggttcagtggcagtggatctgggacagatttcactctcaccatcagcagtctgcaacctgaagattttgcaacttactactgtcaacagagttacagtacccctcccgccttcggccaagggaccaaggtggaaatcaaa

SEQ ID NO: 1186 - protein, 245 aa, Artificial Sequence
  NK71 scFv peptide sequence
QVTLKESGPVLVKPTETLTLTCTVSGFSLSNARMGVTWIRQPPGKALEWLAHIFSNDEKSYSTSLKSRLTISKDTSKTQVVLTMTNMDPVDTATYYCARIRDYYDISSYYDYWGQGTLVSVSSGGGGSGGGGSGGGGSDIQMTQSPSAMSASVGDRVTITCRASQDISNYLAWFQQKPGKVPKRLIYAASSLQSGVPSRFSGSGSGTEFTLTISSLLPEDFATYYCLQLNSFPFTFGGGTKVEIN

SEQ ID NO: 1187 - protein, 250 aa, Artificial Sequence
  NK72 scFv peptide sequence
EVQLVQSGAEVKKPGESLKISCKGSGYGFTSYWIGWVRQMPGKGLEWMGIIHPDDSDTKYSPSFQGQVTISADKSISTAYLQWSSLKASDTAMYYCASSYLRGLWGGYFDYWGQGTLVTVSSGGGGSGGGGSGGGGSELQSVLTQPPSASGTPGQRVTISCSGSSSNIGSNYVNWYQQLPGTAPKLLIYGDYQRPSGVPDRFSGSKSGTSASLAISGLRSEDEADYYCATRDDSLSGSVVFGTGTKLTVL

SEQ ID NO: 1188 - DNA, 612 bp, Artificial Sequence
  Membrane-bound human IL15 (mbIL15) DNA sequence
atggccctcccagtaactgccctccttttgcccctcgcactccttcttcatgccgctcgccccaactgggtcaacgtgattagcgatttgaagaaaatcgaggaccttatacagtctatgcatattgacgctacactgtatactgagagtgatgtacacccgtcctgtaaggtaacggccatgaaatgctttcttctggagctccaggtcatcagcttggagtctggggacgcaagcatccacgatacggttgaaaacctcatcatccttgcgaacaactctctctcatctaatggaaacgttacagagagtgggtgtaaggagtgcgaagagttggaagaaaaaaacatcaaagaatttcttcaatccttcgttcacatagtgcaaatgttcattaacacgtccactaccacacccgccccgaggccacctacgccggcaccgactatcgccagtcaacccctctctctgcgccccgaggcttgccggcctgcggctggtggggcggtccacacccggggcctggattttgcgtgcgatatatacatctgggcacctcttgccggcacctgcggagtgctgcttctctcactcgttattacgctgtactgc

SEQ ID NO: 1189 - protein, 204 aa, Artificial Sequence
  Membrane-bound human IL15 (mbIL15) peptide sequence
MALPVTALLLPLALLLHAARPNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSTTTPAPRPPTPAPTIASQPLSLRPEACRPAAGGAVHTRGLDFACDIYIWAPLAGTCGVLLLSLVITLYC

SEQ ID NO: 1190 - DNA, 20 bp, Artificial Sequence
  SMAD3 guide RNA 1
ccgatcgtgaagcgcctgct

SEQ ID NO: 1191 - DNA, 20 bp, Artificial Sequence
  SMAD3 guide RNA 2
cgagaaggcggtcaagagcc

SEQ ID NO: 1192 - DNA, 20 bp, Artificial Sequence
  SMAD3 guide RNA 3
cttggtgttgacgttctgcg

SEQ ID NO: 1193 - DNA, 20 bp, Artificial Sequence
  MAPKAPK guide RNA 1
ctctgctgtttcaccatcca

SEQ ID NO: 1194 - DNA, 20 bp, Artificial Sequence
  MAPKAPK guide RNA 2
cccggcttgggcggtgctcc

SEQ ID NO: 1195 - DNA, 20 bp, Artificial Sequence
  MAPKAPK guide RNA 3
cgactaccagttgtccaagc

SEQ ID NO: 1196 - DNA, 20 bp, Artificial Sequence
  CEACAM1 guide RNA 1
gactgagttattggcgtggc

SEQ ID NO: 1197 - DNA, 20 bp, Artificial Sequence
  CEACAM1 guide RNA 2
gaatgttccattgataagcc

SEQ ID NO: 1198 - DNA, 20 bp, Artificial Sequence
  CEACAM1 guide RNA 3
gagaggctgaggtttgcccc

SEQ ID NO: 1199 - DNA, 20 bp, Artificial Sequence
  DDIT4 guide RNA 1
cctcaccatgcctagccttt

SEQ ID NO: 1200 - DNA, 20 bp, Artificial Sequence
  DDIT4 guide RNA 2
cgatctggggtgggagttcg

SEQ ID NO: 1201 - DNA, 20 bp, Artificial Sequence
  DDIT4 guide RNA 3
gtttgaccgctccacgagcc

SEQ ID NO: 1202 - protein, 9 aa, Artificial Sequence
  CDR-H1 consensus sequence 1
  MISC_FEATURE (1)..(1): G, Y
  MISC_FEATURE (4)..(4): R, T
  MISC_FEATURE (5)..(5): D, E, N, S
  MISC_FEATURE (6)..(6): N, Y
  MISC_FEATURE (7)..(7): A, D, E, G, Y
  MISC_FEATURE (8)..(8): I, L, M
  MISC_FEATURE (9)..(9): H, N, S
XTFXXXXXX

SEQ ID NO: 1203 - protein, 13 aa, Artificial Sequence
  CDR-H2 consensus sequence 1
  MISC_FEATURE (2)..(2): G, I, V, W
  MISC_FEATURE (3)..(3): I, M
  MISC_FEATURE (4)..(4): I, N, S
  MISC_FEATURE (5)..(5): A, P
  MISC_FEATURE (6)..(6): I, N, S, Y
  MISC_FEATURE (7)..(7): F, G, N, S
  MISC_FEATURE (9)..(9): A, D, G, H, N, S, T
  MISC_FEATURE (10)..(10): A, T
  MISC_FEATURE (11)..(11): G, I, N, S
GXXXXXXGXXXYA

SEQ ID NO: 1204 - protein, 21 aa, Artificial Sequence
  CDR-H3 consensus sequence 1
  MISC_FEATURE (3)..(3): G, K, R
  MISC_FEATURE (4)..(4): D, E, G, S, Y
  MISC_FEATURE (5)..(5): F, H, I, M, P, R, S, W, Y
  MISC_FEATURE (6)..(6): G, S, V
  MISC_FEATURE (7)..(7): no amino acid, A, D, G, V
  MISC_FEATURE (8)..(8): no amino acid, A, G, N, W, Y
  MISC_FEATURE (9)..(9): no amino acid, A, P, T, Y
  MISC_FEATURE (10)..(10): no amino acid, A, E, G, H, R, Y
  MISC_FEATURE (11)..(11): no amino acid, A, D, G, H, S
  MISC_FEATURE (12)..(12): no amino acid, D, F, G, W
  MISC_FEATURE (13)..(13): no amino acid, A, D, E, G, V, Y
  MISC_FEATURE (14)..(14): no amino acid, F, M, Y
  MISC_FEATURE (15)..(15): no amino acid, Y
  MISC_FEATURE (16)..(16): no amino acid, Y
  MISC_FEATURE (17)..(17): no amino acid, G
  MISC_FEATURE (18)..(18): no amino acid, M
  MISC_FEATURE (19)..(19): D, G
  MISC_FEATURE (20)..(20): I, L, V, Y
CAXXXXXXXXXXXXXXXXXXW

SEQ ID NO: 1205 - protein, 11 aa, Artificial Sequence
  CDR-L1 consensus sequence 1
  MISC_FEATURE (1)..(1): Q, R
  MISC_FEATURE (5)..(5): D, G, S, T
  MISC_FEATURE (6)..(6): I, V
  MISC_FEATURE (7)..(7): G, R, S
  MISC_FEATURE (8)..(8): N, R, S
  MISC_FEATURE (9)..(9): F, W, Y
  MISC_FEATURE (11)..(11): A, N
XASQXXXXXLX

SEQ ID NO: 1206 - protein, 7 aa, Artificial Sequence
  CDR-L2 consensus sequence 1
  MISC_FEATURE (1)..(1): A, D, G
  MISC_FEATURE (2)..(2): A, T
  MISC_FEATURE (4)..(4): D, N, S, T
  MISC_FEATURE (5)..(5): L, R
  MISC_FEATURE (6)..(6): A, E, Q
  MISC_FEATURE (7)..(7): A, N, S, T
XXSXXXX

SEQ ID NO: 1207 - protein, 11 aa, Artificial Sequence
  CDR-L3 consensus sequence 1
  MISC_FEATURE (4)..(4): A, S, Y
  MISC_FEATURE (5)..(5): D, H, I, Y
  MISC_FEATURE (6)..(6): N, S, T
  MISC_FEATURE (7)..(7): A, F, P, S, T
  MISC_FEATURE (8)..(8): L, P
  MISC_FEATURE (9)..(9): L, S, T, V, W, Y
  MISC_FEATURE (10)..(10): no amino acid, F, T
  MISC_FEATURE (11)..(11): no amino acid, F
CQQXXXXXXXX

SEQ ID NO: 1208 - protein, 12 aa, Artificial Sequence
  CDR-H1 consensus sequence 2
  MISC_FEATURE (1)..(1): F, G, N, Y
  MISC_FEATURE (2)..(2): I, R, S, T, V
  MISC_FEATURE (3)..(3): F, L
  MISC_FEATURE (4)..(4): A, D, I, N, R, S, T
  MISC_FEATURE (5)..(5): A, D, E, G, N, R, S, T
  MISC_FEATURE (6)..(6): no amino acid, H, S, Y
  MISC_FEATURE (7)..(7): no amino acid, A, D, G, T, V
  MISC_FEATURE (8)..(8): no amino acid, D, F, I, M
  MISC_FEATURE (9)..(9): H, N, Q, S, Y
  MISC_FEATURE (10)..(10): no amino acid, A, E, F, G, H, L, S, Y
  MISC_FEATURE (11)..(11): no amino acid, I, L, M, T, V
  MISC_FEATURE (12)..(12): no amino acid, H, Y
XXXXXXXXXXXX

SEQ ID NO: 1209 - protein, 14 aa, Artificial Sequence
  CDR-H2 consensus sequence 2
  MISC_FEATURE (1)..(1): A, G, S
  MISC_FEATURE (2)..(2): A, G, I, M, R, S, T, V, W
  MISC_FEATURE (3)..(3): no amino acid, F, I, M, V
  MISC_FEATURE (4)..(4): D, I, N, S, T
  MISC_FEATURE (5)..(5): A, K, P, S, T
  MISC_FEATURE (6)..(6): D, G, H, I, M, N, R, S, T, Y
  MISC_FEATURE (7)..(7): A, D, F, G, N, S, T
  MISC_FEATURE (8)..(8): A, G
  MISC_FEATURE (9)..(9): A, D, G, H, I, K, N, R, S, T, V, Y
  MISC_FEATURE (10)..(10): A, E, N, P, S, T
  MISC_FEATURE (11)..(11): A, D, G, H, I, K, L, N, Q, S, T, Y
  MISC_FEATURE (12)..(12): F, N, Y
  MISC_FEATURE (13)..(13): A, Y
  MISC_FEATURE (14)..(14): no amino acid, A, V
XXXXXXXXXXXXXX

SEQ ID NO: 1210 - protein, 28 aa, Artificial Sequence
  CDR-H3 consensus sequence 2
  MISC_FEATURE (1)..(1): no amino acid, C
  MISC_FEATURE (2)..(2): no amino acid, A, C
  MISC_FEATURE (3)..(3): no amino acid, A, C, K, V
  MISC_FEATURE (4)..(4): no amino acid, A, D, G, K, M, R, S, W
  MISC_FEATURE (5)..(5): no amino acid, A, D, E, G, H, T, V
  MISC_FEATURE (6)..(6): no amino acid, C, D, E, F, G, H, L, M, N, P, Q, R, S, T, V, Y
  MISC_FEATURE (7)..(7): no amino acid, A, D, E, G, I, L, M, N, Q, R, S, V, Y
  MISC_FEATURE (8)..(8): no amino acid, A, F, I, L, P, R, T, V, W, Y
  MISC_FEATURE (9)..(9): no amino acid, D, E, Y
  MISC_FEATURE (10)..(10): no amino acid, G, S, V, Y
  MISC_FEATURE (11)..(11): no amino acid, E, G, I, S
  MISC_FEATURE (12)..(12): no amino acid, G
  MISC_FEATURE (13)..(13): no amino acid, L, T
  MISC_FEATURE (14)..(14): no amino acid, D, L, T
  MISC_FEATURE (15)..(15): no amino acid, A, C, D, G, H, P
  MISC_FEATURE (16)..(16): no amino acid, A, C, F, G, L, M, Y
  MISC_FEATURE (17)..(17): no amino acid, A, C, D, E, G, K, N, R, S, T, V
  MISC_FEATURE (18)..(18): no amino acid, A, C, D, E, G, I, L, N, P, R, S, T, V, W, Y
  MISC_FEATURE (19)..(19): no amino acid, A, D, E, F, G, H, K, L, N, Q, R, S, T, W, Y
  MISC_FEATURE (20)..(20): no amino acid, A, C, D, E, G, I, M, P, Q, S, T, V, W, Y
  MISC_FEATURE (21)..(21): no amino acid, A, D, E, F, G, H, L, Q, S, V, W, Y
  MISC_FEATURE (22)..(22): no amino acid, A, D, E, F, G, H, I, L, M, N, P, Q, S, T, W, Y
  MISC_FEATURE (23)..(23): no amino acid, A, D, E, G, H, L, P, S, T, V, W, Y
  MISC_FEATURE (24)..(24): no amino acid, A, D, E, F, G, I, L, Q, S, T, V, W, Y
  MISC_FEATURE (25)..(25): no amino acid, A, F, I, L, M, S, V, Y
  MISC_FEATURE (26)..(26): no amino acid, D, G, L, V
  MISC_FEATURE (27)..(27): I, L, N, P, V, Y
XXXXXXXXXXXXXXXXXXXXXXXXXXXW

SEQ ID NO: 1211 - protein, 17 aa, Artificial Sequence
  CDR-L1 consensus sequence 2
  MISC_FEATURE (1)..(1): K, Q, R
  MISC_FEATURE (2)..(2): A, S, T
  MISC_FEATURE (4)..(4): E, H, Q, S, T
  MISC_FEATURE (5)..(5): no amino acid, S
  MISC_FEATURE (6)..(6): no amino acid, L, V
  MISC_FEATURE (7)..(7): no amino acid, L
  MISC_FEATURE (8)..(8): no amino acid, H, Y
  MISC_FEATURE (9)..(9): no amino acid, S
  MISC_FEATURE (10)..(10): no amino acid, S
  MISC_FEATURE (11)..(11): D, E, G, N, R, S, T
  MISC_FEATURE (12)..(12): G, I, N, V
  MISC_FEATURE (13)..(13): D, G, K, N, R, S, T, Y
  MISC_FEATURE (14)..(14): D, G, H, I, K, N, R, S, T
  MISC_FEATURE (15)..(15): D, F, G, N, S, W, Y
  MISC_FEATURE (16)..(16): L, V
  MISC_FEATURE (17)..(17): A, D, G, H, N
XXSXXXXXXXXXXXXXX

SEQ ID NO: 1212 - protein, 7 aa, Artificial Sequence
  CDR-L2 consensus sequence 2
  MISC_FEATURE (1)..(1): A, D, E, G, H, L, Q, S, W, Y
  MISC_FEATURE (2)..(2): A, G, T, V
  MISC_FEATURE (3)..(3): S, T
  MISC_FEATURE (4)..(4): D, N, S, T, Y
  MISC_FEATURE (5)..(5): L, R
  MISC_FEATURE (6)..(6): A, D, E, H, Q
  MISC_FEATURE (7)..(7): A, G, I, N, R, S, T
XXXXXXX

SEQ ID NO: 1213 - protein, 11 aa, Artificial Sequence
  CDR-L3 consensus sequence 2
  MISC_FEATURE (1)..(1): C, L
  MISC_FEATURE (2)..(2): L, M, Q, S
  MISC_FEATURE (3)..(3): K, Q, T
  MISC_FEATURE (4)..(4): A, D, G, N, S, T, Y
  MISC_FEATURE (5)..(5): A, D, F, H, I, L, N, R, T, Y
  MISC_FEATURE (6)..(6): A, D, E, G, H, I, N, Q, R, S, T
  MISC_FEATURE (7)..(7): A, F, G, I, P, S, T, W, Y
  MISC_FEATURE (8)..(8): L, P, T
  MISC_FEATURE (9)..(9): A, F, I, L, M, P, S, T, V, W, Y
  MISC_FEATURE (10)..(10): no amino acid, A, F, H, R, S, T
  MISC_FEATURE (11)..(11): no amino acid, F
XXXXXXXXXXX

SEQ ID NO: 1214 - RNA, 23 nt, Artificial Sequence
  CD70 guide RNA 1 as RNA
ucaccaagcccgcgaccaauggg

What is claimed is:

1. A population of genetically engineered natural killer (NK) cells, comprising a plurality of NK cells that have been expanded in culture,
wherein the plurality of NK cells are engineered to express a chimeric antigen receptor (CAR) comprising a tumor binding domain that targets CD70, a transmembrane domain, and a cytotoxic signaling complex comprising an OX-40 subdomain and a CD3zeta subdomain,
wherein the NK cells are engineered to express membrane bound IL-15 (mbIL15),
wherein the NK cells are genetically edited at the endogenous CD70 gene to express a reduced level of CD70 protein as compared to a NK cell that has been expanded in culture and in which the endogenous CD70 gene has not been edited, and
wherein the tumor binding domain comprises a heavy chain variable (VH) region and a light chain variable (VL) region, and:
  (a) the VH region comprises a CDR-H1, a CDR-H2, and a CDR-H3 contained within the VH region amino acid sequence set forth in SEQ ID NO:956; and the VL region comprises a CDR-L1, a CDR-L2, and a CDR-L3 contained within the VL region amino acid sequence set forth in SEQ ID NO:1030;
  (b) the VH region comprises a CDR-H1, a CDR-H2, and a CDR-H3 contained within the VH region amino acid sequence set forth in SEQ ID NO:905; and the VL region comprises a CDR-L1, a CDR-L2, and a CDR-L3 contained within the VL region amino acid sequence set forth in SEQ ID NO:979;
  (c) the VH region comprises a CDR-H1, a CDR-H2, and a CDR-H3 contained within the VH region amino acid sequence set forth in SEQ ID NO:943; and the VL region comprises a CDR-L1, a CDR-L2, and a CDR-L3 contained within the VL region amino acid sequence set forth in SEQ ID NO:1017;
  (d) the VH region comprises a CDR-H1, a CDR-H2, and a CDR-H3 contained within the VH region amino acid sequence set forth in SEQ ID NO:899; and the VL region comprises a CDR-L1, a CDR-L2, and a CDR-L3 contained within the VL region amino acid sequence set forth in SEQ ID NO:973;
  (e) the VH region comprises a CDR-H1, a CDR-H2, and a CDR-H3 contained within the VH region amino acid sequence set forth in SEQ ID NO:958; and the VL region comprises a CDR-L1, a CDR-L2, and a CDR-L3 contained within the VL region amino acid sequence set forth in SEQ ID NO:1032;
  (f) the VH region comprises a CDR-H1, a CDR-H2, and a CDR-H3 contained within the VH region amino acid sequence set forth in SEQ ID NO:904; and the VL region comprises a CDR-L1, a CDR-L2, and a CDR-L3 contained within the VL region amino acid sequence set forth in SEQ ID NO:978;
  (g) the VH region comprises a CDR-H1, a CDR-H2, and a CDR-H3 contained within the VH region amino acid sequence set forth in SEQ ID NO:929; and the VL region comprises a CDR-L1, a CDR-L2, and a CDR-L3 contained within the VL region amino acid sequence set forth in SEQ ID NO:1003;
  (h) the VH region comprises a CDR-H1, a CDR-H2, and a CDR-H3 contained within the VH region amino acid sequence set forth in SEQ ID NO:916; and the VL region comprises a CDR-L1, a CDR-L2, and a CDR-L3 contained within the VL region amino acid sequence set forth in SEQ ID NO:990;
  (i) the VH region comprises a CDR-H1, a CDR-H2, and a CDR-H3 contained within the VH region amino acid sequence set forth in SEQ ID NO:950; and the VL region comprises a CDR-L1, a CDR-L2, and a CDR-L3 contained within the VL region amino acid sequence set forth in SEQ ID NO:1024; or
  (j) the VH region comprises a CDR-H1, a CDR-H2, and a CDR-H3 contained within the VH region amino acid sequence set forth in SEQ ID NO:940; and the VL region comprises a CDR-L1, a CDR-L2, and a CDR-L3 contained within the VL region amino acid sequence set forth in SEQ ID NO:1014.

2. The population of genetically engineered NK cells of claim 1,
wherein the NK cells are genetically edited at the endogenous CISH gene to express a reduced level of cytokine-inducible SH2-containing (CIS) protein as compared to a NK cell in which the endogenous CISH gene has not been edited, and
wherein the genetically engineered NK cells exhibit one or more of enhanced expansion capability, enhanced cytotoxicity against target cells, and enhanced persistence, as compared to NK cells expressing native levels of CIS protein.

3. The population of genetically engineered NK cells of claim 1, wherein:

(a) the VH region comprises an amino acid sequence having at least 95% sequence identity to the amino acid sequence of SEQ ID NO:956, and the VL region comprises an amino acid sequence having at least 95% sequence identity to the amino acid sequence of SEQ ID NO:1030;

(b) the VH region comprises an amino acid sequence having at least 95% sequence identity to the amino acid sequence of SEQ ID NO:905, and the VL region comprises an amino acid sequence having at least 95% sequence identity to the amino acid sequence of SEQ ID NO:979;

(c) the VH region comprises an amino acid sequence having at least 95% sequence identity to the amino acid sequence of SEQ ID NO:943, and the VL region comprises an amino acid sequence having at least 95% sequence identity to the amino acid sequence of SEQ ID NO:1017;

(d) the VH region comprises an amino acid sequence having at least 95% sequence identity to the amino acid sequence of SEQ ID NO:899, and the VL region comprises an amino acid sequence having at least 95% sequence identity to the amino acid sequence of SEQ ID NO:973;

(e) the VH region comprises an amino acid sequence having at least 95% sequence identity to the amino acid sequence of SEQ ID NO:958, and the VL region comprises an amino acid sequence having at least 95% sequence identity to the amino acid sequence of SEQ ID NO:1032;

(f) the VH region comprises an amino acid sequence having at least 95% sequence identity to the amino acid sequence of SEQ ID NO:904, and the VL region comprises an amino acid sequence having at least 95% sequence identity to the amino acid sequence of SEQ ID NO:978;

(g) the VH region comprises an amino acid sequence having at least 95% sequence identity to the amino acid sequence of SEQ ID NO:929, and the VL region comprises an amino acid sequence having at least 95% sequence identity to the amino acid sequence of SEQ ID NO:1003;

(h) the VH region comprises an amino acid sequence having at least 95% sequence identity to the amino acid sequence of SEQ ID NO:916, and the VL region comprises an amino acid sequence having at least 95% sequence identity to the amino acid sequence of SEQ ID NO:990;

(i) the VH region comprises an amino acid sequence having at least 95% sequence identity to the amino acid sequence of SEQ ID NO:950, and the VL region comprises an amino acid sequence having at least 95% sequence identity to the amino acid sequence of SEQ ID NO:1024; or (j) the VH region comprises an amino acid sequence having at least 95% sequence identity to the amino acid sequence of SEQ ID NO:940, and the VL region comprises an amino acid sequence having at least 95% sequence identity to the amino acid sequence of SEQ ID NO:1014.

4. The population of genetically engineered NK cells of claim 1, wherein:

(a) the VH region comprises the amino acid sequence of SEQ ID NO:956, and the VL region comprises the amino acid sequence of SEQ ID NO:1030;

(b) the VH region comprises the amino acid sequence of SEQ ID NO:905, and the VL region comprises the amino acid sequence of SEQ ID NO:979;

(c) the VH region comprises the amino acid sequence of SEQ ID NO:943, and the VL region comprises the amino acid sequence of SEQ ID NO:1017;

(d) the VH region comprises the amino acid sequence of SEQ ID NO:899, and the VL region comprises the amino acid sequence of SEQ ID NO:973;

(e) the VH region comprises the amino acid sequence of SEQ ID NO:958, and the VL region comprises the amino acid sequence of SEQ ID NO:1032;

(f) the VH region comprises the amino acid sequence of SEQ ID NO:904, and the VL region comprises the amino acid sequence of SEQ ID NO:978;

(g) the VH region comprises the amino acid sequence of SEQ ID NO:929, and the VL region comprises the amino acid sequence of SEQ ID NO:1003;

(h) the VH region comprises the amino acid sequence of SEQ ID NO:916, and the VL region comprises the amino acid sequence of SEQ ID NO:990;

(i) the VH region comprises the amino acid sequence of SEQ ID NO:950, and the VL region comprises the amino acid sequence of SEQ ID NO:1024; or (j) the VH region comprises the amino acid sequence of SEQ ID NO:940, and the VL region comprises the amino acid sequence of SEQ ID NO:1014.

5. The population of genetically engineered NK cells of claim 1, wherein the tumor binding domain comprises an scFv comprising the amino acid sequence of SEQ ID NO: 296, 245, 283, 239, 298, 244, 269, 256, 290, or 280.

6. A population of genetically engineered immune cells, comprising a plurality of immune cells that have been expanded in culture, wherein the plurality of immune cells are engineered to express a chimeric antigen receptor (CAR) comprising a tumor binding domain that targets CD70, a transmembrane domain, and a cytotoxic signaling complex, wherein the immune cells are genetically edited at the endogenous CD70 gene to express a reduced level of CD70 protein as compared to an immune cell that has been expanded in culture and in which the endogenous CD70 gene has not been edited, wherein the immune cells are genetically edited at the endogenous CISH gene to express a reduced level of the cytokine-inducible SH2-containing (CIS) protein as compared to an immune cell in which the endogenous CISH gene has not been edited, and wherein the immune cells are genetically edited to express a reduced level of one or more of: an A2A adenosine receptor, an A2B adenosine receptor, an A3 adenosine receptor, an A1 adenosine receptor, a transforming growth factor beta receptor (TGFBR), a Cbl proto-oncogene B (Cblb) protein, beta-2 microglobulin (B2M), CIITA (class II major histocompatibility complex transactivator), Natural Killer Group 2, member A (NKG2A) receptor, tripartite motif-containing protein 29 (TRIM29) protein, and a suppressor of cytokine signaling 2 (SOCS2) protein, as compared to a non-edited immune cell, and wherein the tumor binding domain comprises a heavy chain variable (VH) region and a light chain variable (VL) region and:

(a) the VH region comprises a CDR-H1, a CDR-H2, and a CDR-H3 contained within the VH region amino acid sequence set forth in SEQ ID NO:956; and the VL region comprises a CDR-L1, a CDR-L2, and a CDR-L3 contained within the VL region amino acid sequence set forth in SEQ ID NO:1030;

(b) the VH region comprises a CDR-H1, a CDR-H2, and a CDR-H3 contained within the VH region amino acid sequence set forth in SEQ ID NO:905; and the VL region comprises a CDR-L1, a CDR-L2, and a CDR-L3 contained within the VL region amino acid sequence set forth in SEQ ID NO:979;

(c) the VH region comprises a CDR-H1, a CDR-H2, and a CDR-H3 contained within the VH region amino acid sequence set forth in SEQ ID NO:943; and the VL region comprises a CDR-L1, a CDR-L2, and a CDR-L3 contained within the VL region amino acid sequence set forth in SEQ ID NO:1017;

(d) the VH region comprises a CDR-H1, a CDR-H2, and a CDR-H3 contained within the VH region amino acid sequence set forth in SEQ ID NO:899; and the VL region comprises a CDR-L1, a CDR-L2, and a CDR-L3 contained within the VL region amino acid sequence set forth in SEQ ID NO:973;

(e) the VH region comprises a CDR-H1, a CDR-H2, and a CDR-H3 contained within the VH region amino acid sequence set forth in SEQ ID NO:958; and the VL region comprises a CDR-L1, a CDR-L2, and a CDR-L3 contained within the VL region amino acid sequence set forth in SEQ ID NO:1032;

(f) the VH region comprises a CDR-H1, a CDR-H2, and a CDR-H3 contained within the VH region amino acid sequence set forth in SEQ ID NO:904; and the VL region comprises a CDR-L1, a CDR-L2, and a CDR-L3 contained within the VL region amino acid sequence set forth in SEQ ID NO:978;

(g) the VH region comprises a CDR-H1, a CDR-H2, and a CDR-H3 contained within the VH region amino acid sequence set forth in SEQ ID NO:929; and the VL region comprises a CDR-L1, a CDR-L2, and a CDR-L3 contained within the VL region amino acid sequence set forth in SEQ ID NO:1003;

(h) the VH region comprises a CDR-H1, a CDR-H2, and a CDR-H3 contained within the VH region amino acid sequence set forth in SEQ ID NO:916; and the VL region comprises a CDR-L1, a CDR-L2, and a CDR-L3 contained within the VL region amino acid sequence set forth in SEQ ID NO:990;

(i) the VH region comprises a CDR-H1, a CDR-H2, and a CDR-H3 contained within the VH region amino acid sequence set forth in SEQ ID NO:950; and the VL region comprises a CDR-L1, a CDR-L2, and a CDR-L3 contained within the VL region amino acid sequence set forth in SEQ ID NO:1024; or (j) the VH region comprises a CDR-H1, a CDR-H2, and a CDR-H3 contained within the VH region amino acid sequence set forth in SEQ ID NO:940; and the VL region comprises a CDR-L1, a CDR-L2, and a CDR-L3 contained within the VL region amino acid sequence set forth in SEQ ID NO:1014.

7. The population of genetically engineered immune cells of claim 6, wherein the immune cells are genetically edited to express a reduced level of a Cbl proto-oncogene B (Cblb) protein.

8. The population of genetically engineered immune cells of claim 6, wherein the cytotoxic signaling complex comprises an OX-40 subdomain and a CD3zeta subdomain, and wherein the immune cells are engineered to express membrane bound IL-15 (mbIL15).

9. The population of genetically engineered immune cells of claim 6, wherein the population of immune cells comprises NK cells.

10. An anti-CD70 chimeric antigen receptor (CAR), wherein the CAR comprises:

(i) an anti-CD70 binding domain comprising a heavy chain variable (VH) region and a light chain variable (VL) region, wherein:

(a) the VH region comprises a CDR-H1, a CDR-H2, and a CDR-H3 contained within the VH region amino acid sequence set forth in SEQ ID NO:956; and the VL region comprises a CDR-L1, a CDR-L2, and a CDR-L3 contained within the VL region amino acid sequence set forth in SEQ ID NO:1030;

(b) the VH region comprises a CDR-H1, a CDR-H2, and a CDR-H3 contained within the VH region amino acid sequence set forth in SEQ ID NO:905; and the VL region comprises a CDR-L1, a CDR-L2, and a CDR-L3 contained within the VL region amino acid sequence set forth in SEQ ID NO:979;

(c) the VH region comprises a CDR-H1, a CDR-H2, and a CDR-H3 contained within the VH region amino acid sequence set forth in SEQ ID NO:943; and the VL region comprises a CDR-L1, a CDR-L2, and a CDR-L3 contained within the VL region amino acid sequence set forth in SEQ ID NO:1017;

(d) the VH region comprises a CDR-H1, a CDR-H2, and a CDR-H3 contained within the VH region amino acid sequence set forth in SEQ ID NO:899; and the VL region comprises a CDR-L1, a CDR-L2, and a CDR-L3 contained within the VL region amino acid sequence set forth in SEQ ID NO:973;

(e) the VH region comprises a CDR-H1, a CDR-H2, and a CDR-H3 contained within the VH region amino acid sequence set forth in SEQ ID NO:958; and the VL region comprises a CDR-L1, a CDR-L2, and a CDR-L3 contained within the VL region amino acid sequence set forth in SEQ ID NO:1032;

(f) the VH region comprises a CDR-H1, a CDR-H2, and a CDR-H3 contained within the VH region amino acid sequence set forth in SEQ ID NO:904; and the VL region comprises a CDR-L1, a CDR-L2, and a CDR-L3 contained within the VL region amino acid sequence set forth in SEQ ID NO:978;

(g) the VH region comprises a CDR-H1, a CDR-H2, and a CDR-H3 contained within the VH region amino acid sequence set forth in SEQ ID NO:929; and the VL region comprises a CDR-L1, a CDR-L2, and a CDR-L3 contained within the VL region amino acid sequence set forth in SEQ ID NO:1003;

(h) the VH region comprises a CDR-H1, a CDR-H2, and a CDR-H3 contained within the VH region amino acid sequence set forth in SEQ ID NO:916; and the VL region comprises a CDR-L1, a CDR-L2, and a CDR-L3 contained within the VL region amino acid sequence set forth in SEQ ID NO:990;

(i) the VH region comprises a CDR-H1, a CDR-H2, and a CDR-H3 contained within the VH region amino acid sequence set forth in SEQ ID NO:950; and the VL region comprises a CDR-L1, a CDR-L2, and a CDR-L3 contained within the VL region amino acid sequence set forth in SEQ ID NO:1024; or (j) the VH region comprises a CDR-H1, a CDR-H2, and a CDR-H3 contained within the VH region amino acid sequence set forth in SEQ ID NO:940; and the VL region comprises a CDR-L1, a CDR-L2, and a CDR-L3 contained within the VL region amino acid sequence set forth in SEQ ID NO:1014;
(ii) a transmembrane domain; and
(iii) a cytotoxic signaling complex.

11. An anti-CD70 binding domain comprising a heavy chain variable (VH) region and a light chain variable (VL) region, wherein:
(a) the VH region comprises a CDR-H1, a CDR-H2, and a CDR-H3 contained within the VH region amino acid sequence set forth in SEQ ID NO:956; and the VL region comprises a CDR-L1, a CDR-L2, and a CDR-L3 contained within the VL region amino acid sequence set forth in SEQ ID NO:1030;
(b) the VH region comprises a CDR-H1, a CDR-H2, and a CDR-H3 contained within the VH region amino acid sequence set forth in SEQ ID NO:905; and the VL region comprises a CDR-L1, a CDR-L2, and a CDR-L3 contained within the VL region amino acid sequence set forth in SEQ ID NO:979;
(c) the VH region comprises a CDR-H1, a CDR-H2, and a CDR-H3 contained within the VH region amino acid sequence set forth in SEQ ID NO:943; and the VL region comprises a CDR-L1, a CDR-L2, and a CDR-L3 contained within the VL region amino acid sequence set forth in SEQ ID NO:1017;
(d) the VH region comprises a CDR-H1, a CDR-H2, and a CDR-H3 contained within the VH region amino acid sequence set forth in SEQ ID NO:899; and the VL region comprises a CDR-L1, a CDR-L2, and a CDR-L3 contained within the VL region amino acid sequence set forth in SEQ ID NO:973;
(e) the VH region comprises a CDR-H1, a CDR-H2, and a CDR-H3 contained within the VH region amino acid sequence set forth in SEQ ID NO:958; and the VL region comprises a CDR-L1, a CDR-L2, and a CDR-L3 contained within the VL region amino acid sequence set forth in SEQ ID NO:1032;
(f) the VH region comprises a CDR-H1, a CDR-H2, and a CDR-H3 contained within the VH region amino acid sequence set forth in SEQ ID NO:904; and the VL region comprises a CDR-L1, a CDR-L2, and a CDR-L3 contained within the VL region amino acid sequence set forth in SEQ ID NO:978;
(g) the VH region comprises a CDR-H1, a CDR-H2, and a CDR-H3 contained within the VH region amino acid sequence set forth in SEQ ID NO:929; and the VL region comprises a CDR-L1, a CDR-L2, and a CDR-L3 contained within the VL region amino acid sequence set forth in SEQ ID NO:1003;
(h) the VH region comprises a CDR-H1, a CDR-H2, and a CDR-H3 contained within the VH region amino acid sequence set forth in SEQ ID NO:916; and the VL region comprises a CDR-L1, a CDR-L2, and a CDR-L3 contained within the VL region amino acid sequence set forth in SEQ ID NO:990;
(i) the VH region comprises a CDR-H1, a CDR-H2, and a CDR-H3 contained within the VH region amino acid sequence set forth in SEQ ID NO:950; and the VL region comprises a CDR-L1, a CDR-L2, and a CDR-L3 contained within the VL region amino acid sequence set forth in SEQ ID NO:1024; or
(j) the VH region comprises a CDR-H1, a CDR-H2, and a CDR-H3 contained within the VH region amino acid sequence set forth in SEQ ID NO:940; and the VL region comprises a CDR-L1, a CDR-L2, and a CDR-L3 contained within the VL region amino acid sequence set forth in SEQ ID NO:1014.

12. The population of genetically engineered NK cells of claim 1, wherein the NK cells are genetically edited to express a reduced level of a Cbl proto-oncogene B (Cblb) protein.

13. The population of genetically engineered NK cells of claim 2, wherein the NK cells are genetically edited to express a reduced level of a Cbl proto-oncogene B (Cblb) protein.

14. The anti-CD70 CAR of claim 10, wherein the cytotoxic signaling complex comprises an OX-40 subdomain and a CD3zeta subdomain.

15. The anti-CD70 CAR of claim 10, wherein the transmembrane domain comprises a CD8alpha transmembrane region.

16. The anti-CD70 binding domain of claim 11, wherein the VH region comprises a CDR-H1, a CDR-H2, and a CDR-H3 contained within the VH region amino acid sequence set forth in SEQ ID NO:956; and the VL region comprises a CDR-L1, a CDR-L2, and a CDR-L3 contained within the VL region amino acid sequence set forth in SEQ ID NO:1030.

17. The anti-CD70 binding domain of claim 11, wherein:
(a) the VH region comprises an amino acid sequence having at least 95% sequence identity to the amino acid sequence of SEQ ID NO: 956, and the VL region comprises an amino acid sequence having at least 95% sequence identity to the amino acid sequence of SEQ ID NO:1030;
(b) the VH region comprises an amino acid sequence having at least 95% sequence identity to the amino acid sequence of SEQ ID NO:905, and the VL region comprises an amino acid sequence having at least 95% sequence identity to the amino acid sequence of SEQ ID NO:979;
(c) the VH region comprises an amino acid sequence having at least 95% sequence identity to the amino acid sequence of SEQ ID NO:943, and the VL region comprises an amino acid sequence having at least 95% sequence identity to the amino acid sequence of SEQ ID NO:1017;
(d) the VH region comprises an amino acid sequence having at least 95% sequence identity to the amino acid sequence of SEQ ID NO:899, and the VL region comprises an amino acid sequence having at least 95% sequence identity to the amino acid sequence of SEQ ID NO:973;
(e) the VH region comprises an amino acid sequence having at least 95% sequence identity to the amino acid sequence of SEQ ID NO:958, and the VL region comprises an amino acid sequence having at least 95% sequence identity to the amino acid sequence of SEQ ID NO:1032;
(f) the VH region comprises an amino acid sequence having at least 95% sequence identity to the amino acid sequence of SEQ ID NO:904, and the VL region comprises an amino acid sequence having at least 95% sequence identity to the amino acid sequence of SEQ ID NO:978;
(g) the VH region comprises an amino acid sequence having at least 95% sequence identity to the amino acid sequence of SEQ ID NO:929, and the VL region comprises an amino acid sequence having at least 95% sequence identity to the amino acid sequence of SEQ ID NO:1003;
(h) the VH region comprises an amino acid sequence having at least 95% sequence identity to the amino acid sequence of SEQ ID NO:916, and the VL region comprises an amino acid sequence having at least 95% sequence identity to the amino acid sequence of SEQ ID NO:990;

(i) the VH region comprises an amino acid sequence having at least 95% sequence identity to the amino acid sequence of SEQ ID NO:950, and the VL region comprises an amino acid sequence having at least 95% sequence identity to the amino acid sequence of SEQ ID NO:1024; or (j) the VH region comprises an amino acid sequence having at least 95% sequence identity to the amino acid sequence of SEQ ID NO:940, and the VL region comprises an amino acid sequence having at least 95% sequence identity to the amino acid sequence of SEQ ID NO:1014.

18. The anti-CD70 binding domain of claim 11, wherein the VH region comprises an amino acid sequence having at least 95% sequence identity to the amino acid sequence of SEQ ID NO: 956, and the VL region comprises an amino acid sequence having at least 95% sequence identity to the amino acid sequence of SEQ ID NO:1030.

19. The anti-CD70 binding domain of claim 11, wherein:

(a) the VH region comprises the amino acid sequence of SEQ ID NO:956, and the VL region comprises the amino acid sequence of SEQ ID NO:1030;

(b) the VH region comprises the amino acid sequence of SEQ ID NO:905, and the VL region comprises the amino acid sequence of SEQ ID NO:979;

(c) the VH region comprises the amino acid sequence of SEQ ID NO:943, and the VL region comprises the amino acid sequence of SEQ ID NO:1017;

(d) the VH region comprises the amino acid sequence of SEQ ID NO:899, and the VL region comprises the amino acid sequence of SEQ ID NO:973;

(e) the VH region comprises the amino acid sequence of SEQ ID NO:958, and the VL region comprises the amino acid sequence of SEQ ID NO:1032;

(f) the VH region comprises the amino acid sequence of SEQ ID NO:904, and the VL region comprises the amino acid sequence of SEQ ID NO:978;

(g) the VH region comprises the amino acid sequence of SEQ ID NO:929, and the VL region comprises the amino acid sequence of SEQ ID NO:1003;

(h) the VH region comprises the amino acid sequence of SEQ ID NO:916, and the VL region comprises the amino acid sequence of SEQ ID NO:990;

(i) the VH region comprises the amino acid sequence of SEQ ID NO:950, and the VL region comprises the amino acid sequence of SEQ ID NO:1024; or (j) the VH region comprises the amino acid sequence of SEQ ID NO:940, and the VL region comprises the amino acid sequence of SEQ ID NO:1014.

20. The anti-CD70 binding domain of claim 11, wherein the VH region comprises the amino acid sequence of SEQ ID NO:956, and the VL region comprises the amino acid sequence of SEQ ID NO:1030.

21. The population of genetically engineered NK cells of claim 1, wherein the VH region comprises a CDR-H1, a CDR-H2, and a CDR-H3 contained within the VH region amino acid sequence set forth in SEQ ID NO:956; and the VL region comprises a CDR-L1, a CDR-L2, and a CDR-L3 contained within the VL region amino acid sequence set forth in SEQ ID NO:1030.

22. The population of genetically engineered NK cells of claim 1, wherein the VH region comprises the amino acid sequence of SEQ ID NO:956, and the VL region comprises the amino acid sequence of SEQ ID NO:1030.

23. The anti-CD70 CAR of claim 10, wherein the VH region comprises a CDR-H1, a CDR-H2, and a CDR-H3 contained within the VH region amino acid sequence set forth in SEQ ID NO:956; and the VL region comprises a CDR-L1, a CDR-L2, and a CDR-L3 contained within the VL region amino acid sequence set forth in SEQ ID NO:1030.

24. The population of genetically engineered NK cells of claim 1, wherein the VH region comprises a CDR-H1, a CDR-H2, and a CDR-H3 contained within the VH region amino acid sequence set forth in SEQ ID NO:905; and the VL region comprises a CDR-L1, a CDR-L2, and a CDR-L3 contained within the VL region amino acid sequence set forth in SEQ ID NO:979.

25. The population of genetically engineered NK cells of claim 1, wherein the VH region comprises the amino acid sequence of SEQ ID NO:905, and the VL region comprises the amino acid sequence of SEQ ID NO:979.

26. The anti-CD70 CAR of claim 10, wherein the VH region comprises a CDR-H1, a CDR-H2, and a CDR-H3 contained within the VH region amino acid sequence set forth in SEQ ID NO:905; and the VL region comprises a CDR-L1, a CDR-L2, and a CDR-L3 contained within the VL region amino acid sequence set forth in SEQ ID NO:979.

* * * * *